United States Patent 7,408,052 (NUCLEIC ACID MOLECULES AND OTHER MOLECULES ASSOCIATED WITH THE CARBON ASSIMILATION PATHWAY) - sequence listing, part 2

SEQ ID NO: 5761 - DNA, 253 bp, Zea mays
  Clone ID: 700218182H1
ggtttaccaggaaaatatatatgttgaagataagccattccactcattcaaaaaaattgcacggtcactgggatacactgatgatgatcttcctttggtatcattccagtcagtttctaaaggctactacggagaatgtggaaaacgaggcggttatatggagataactggattcagtcctgatgtacgggaacaaatttacaaggtggcatcagtaaacctgtgctccaatgtttcggggcaaattcttgct

SEQ ID NO: 5762 - DNA, 265 bp, Zea mays
  Clone ID: 700239054H1
cccacgcgtccgcccacgcgtccgcaaaataaaattgtcgaattctgcaagaatgtaggacttgttcttctcgcagatgaggtttaccaggaaaatatatatgttgaagataagccattccactcattcaaaaaaattgcacggtcactgggatacactgatgatgatcttcctttggtatcattccagtcagtttctaaaggctactacggagaatgtggaaaacgaggcggttatatggagataactggattcagtcctgatg

SEQ ID NO: 5763 - DNA, 243 bp, Zea mays
  unsure (1)...(243): unsure at all n locations
  Clone ID: 700207743H1
ttctcgcagatgaggtttaccaggaaaatatatatgttgaagataagccattccactcattcanaaaaattgcacggtcactgggatacactgatgatgatcttcctttggtatcattccagtcagtttctagaggctactacggagaatgtggagaacgaggcggttatatggagataactggattcagtcctgaagtacgggaacaaatttacaaggtggcatcagtagacctgtgctcca

SEQ ID NO: 5764 - DNA, 140 bp, Zea mays
  Clone ID: 700049234H1
tggaaaaccaaaagaggattgtcgaattctgcaagaatgaaggacttgttcttctcgcagatgaggtttaccaggcaaatatatatgttgaagataagccattccactcattccaaaaaattgcacggtcactgggatac

SEQ ID NO: 5765 - DNA, 304 bp, Zea mays
  Clone ID: 700257223H1
gtccgcacagccgctcatcgtctcccacagcctgcactctccctgcgccggccggtgccccgacgcgccatgtcgtacaacaaggccccgtccatcaccgccgagaccataaatcccagggtcaagatcatcagatacgcgccttgcggggagatcgtcaagcacgcagcgcggctggagcaggagatagaggagaaccctgcttctatccctttccaagagataatatactgcaacctcgggaacccccaggtccttggtcagccgccactaaatttctttcgtgaggttctctccctgtgcg

SEQ ID NO: 5766 - DNA, 293 bp, Zea mays
  Clone ID: 700267629H1
ctctcgccgtccgcacagccgctcatcgtctcccactgcctgccctctccctgcgccggccggtgccccgacgcgccatgtcgtacaacaaggccccgtccatcaccgccgagaccataaatcccagggtcaagatcatcagatacgcgccttgcggggagatcgtcaagcacgcagcgcggctggagcaggagatagaggagaaccctgcttctatccctttccaagagataatatactgcaacctcgggaacccccaggtccttggtcagccgccactaactttctttcgt

SEQ ID NO: 5767 - DNA, 300 bp, Zea mays
  Clone ID: 700267912H1
agtccgcacagccgctcatcgtctcccactgcctgccctctccctgcgccggccggtgccccgacgcgccatgtcgtacaacaaggccccgtccatcaccgccgagaccataaatcccagggtcaagatcatcagatacgcgccttgcggggagatcgtcaagcacgcagcgggctggagcaggagatagaggagaaccctgcttctatccctttccaagagataatatactgcaacctcgggaacccccaggtccttggtcagccgccactaactttctttcgtgaggttctctccctg

SEQ ID NO: 5768 - DNA, 275 bp, Zea mays
  Clone ID: 700265819H1
cacagccgctcatcgtctcccactgcctgcactctccctgcgccggccggtgccccgacgcgccatgtcgtacaacaaggccccgtccatcaccgccgagaccataaatcccagggtcaagatcatcagatacgcgccttgcggggagatcgtcaagcacgcagcgcggctggagcaggagatagaggagaaccctgcttctatccctttccaagagataatatactgcaacctcgggaacccccaggtccttggtcagcagccactaactttct

SEQ ID NO: 5769 - DNA, 309 bp, Zea mays
  Clone ID: 700047471H1
ggtgcatatagtcacagtcagggtatcaaaggactgcgtgatgcaattgctgctggaatcatgtcacgtgatggattccctgcaaatgcagatgacattttcattacagacggagcaagtcctggggtccacatgatgatgcaattactgattaggaatgagaaagatggcattctgtgcccaattcctcagtaccctttgtactcagcctccatagctcttcatggtggagctcatgtcccctattaccttaatgaaaaaactgggtggggtttggagatctctgatcttaagacgcaactggaaaat

SEQ ID NO: 5770 - DNA, 305 bp, Zea mays
  unsure (1)...(305): unsure at all n locations
  Clone ID: 700446631H1
aagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgatctccctctagtatcatttcagtctgtctccanaggatactatggagagtgtggtaaaag

SEQ ID NO: 5771 - DNA, 290 bp, Zea mays
  Clone ID: 700263484H1
gcgaggatgatctccctctagtatcatttcagtctgtctccaaaggatactatggagagtgtggtaaaagaggaggttacatggagattactggcttcagtgctccggtaagagagcagatctacaaggtagcttcagtgaacctgtgctccaatatcactggtcaaatccttgcgagcctcgtcatgaatccaccaaaggttggggacgaatcatatgcttcctacaaggcagagaaagatggaatccttcagtctttagctcgccgtgcaaaggcactggaagatgca

SEQ ID NO: 5772 - DNA, 309 bp, Zea mays
  Clone ID: 700076095H1
ggagattactggcttcagtgctccggtaagagagcagatctacaaggtagcttcagtgaacctgtgctccaatatcactggtcaaatccttgcgagcctcgtcatgaatccaccaaaggttggggacgaatcatatgcttcctacaaggcagagaaagatggaatccttcagtctttagctcgccgtgcaaaggcactggaagatgcattcaacacgcttgagggattttcatgtaacaaggctgaaggagcaatgtaccttttccctcagatccatctgccacataaggcaattgaggctgctaaagc

SEQ ID NO: 5773 - DNA, 289 bp, Zea mays
  Clone ID: 700042264H1
agaacatctatgttgacaacaagaaatttaactctttcaagaagattgcaagatccatgggatacggcgaggatgatctccctctagtatcatttcagtctgtctccaaaggatactatggagagtgtggtaaaagaggaggttacatggagattactggcttcagtgctccggtaagagagcagatctacaaggtagcttcagtgaacctgtgctccaatatcactggtcaaatccttgcgagcctcgtcatgaatccaccaaatgttggggacgaatcatatgcttc

SEQ ID NO: 5774 - DNA, 282 bp, Zea mays
  Clone ID: 700041605H1
caaaggttggggacgaatcatatgcttcctacaaggcagagaaagatggaatccttcagtctttagctcgccgtgcaaaggcactggaagatgcattcaacacgcttgagggattttcatgtaacaaggctgaaggagcaatgtaccttttccctcagatccatctgccacataaggcaattgaggctgctaaagctgccaagaaagcacctgatgcattctatgcgctccgtctccttgaatcaactggaattgttgtggttcctggatctggatttggcc

SEQ ID NO: 5775 - DNA, 283 bp, Zea mays
  Clone ID: 700258238H1
gcctccatagctcttcatggtggagctcatgtcccctattaccttgatgaaaaaacagggtggggtttggagatctctgatcttaagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaattta

SEQ ID NO: 5776 - DNA, 339 bp, Zea mays
  Clone ID: 700620967H1
aaggttcttgctgaagacaaccaatatgatatagtgagattctgtacaaatgacggccttgttcttctagctgatgaggtatatcaagagaacatctatgttgacaacaagaaatttaactctttcaagaagattgcaagatccatgggatacggcgaggatgatctccctctagtatcatttaagtctgtctccaaaggatactatggagagtgtggtagaagatgaggttacatggagattactggcttcagtgctccggtaagagagcagatctacaaggtagcttcagtgaacctgtgctccaatatcactggtcaaatccttgcgagcatcgtc

SEQ ID NO: 5777 - DNA, 271 bp, Zea mays
  Clone ID: 700046079H1
aaaaactgggtggggtttggagatctctgatcttaagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggc

SEQ ID NO: 5778 - DNA, 296 bp, Zea mays
  Clone ID: 700073909H1
cccacgcgtccgcaggaggttcttgctctttgtgatcatccatgcctcttggaaaaagaggaaaccaaatcattgttcagtgctgatgctatttctcgagcaaagcagattcttgcaactattcctggacgggcaacaggtgcatatagtcacagtcagggtatcaaaggattgcgtgatgcaattgctgctgggatcacctcacgtgacggattccctgcaaatgcagatgacattttcattacagacggagcaagtcctggggtccacatgatgatgcaattactgattaggaa

SEQ ID NO: 5779 - DNA, 273 bp, Zea mays
  Clone ID: 701179662H1
cactggtcaaatccttgcgagcctcgtcatgaatccaccaaaggttggggacgaatcatatgcttcctacaaggcagagaaagatggaatccttcagtctttagctcgccgtgcaaaggcactggaagatgcattcaacacgcttgagggattttcatgtaacaaggctgaaggagcaatgtaccttttccctcagatccatctgccacataaggcaattgaggctgctaaagctgccaagaaagcacctgatgcattctatgcgctccgtct

SEQ ID NO: 5780 - DNA, 275 bp, Zea mays
  Clone ID: 700045425H1
ggtagcttcagtgaacctgtgctccaatatcactggtcaaatccttgcgagcctcgtcatgaatccaccaaaggttggggacgaatcatatgcttcctacaaggcagagaaagatggaatccttcagtctttagctcgccgtgcaaaggcactggaagatgcattcaacacgcttgagggattttcatgtaacaaggctgaaggagcaatgtaccttttccctcagatccatctgccacataaggcaattgaggctgctaaagctgccaagaaag

SEQ ID NO: 5781 - DNA, 268 bp, Zea mays
  Clone ID: 700043325H1
cacagtcagggtatcaaaggattgcgtgatgcaattgctgctgggatcacctcacgtgacggattccctgcaaatgcagatgacattttcattacagacggagcaagtcctggggtccacatgatgatgcaattactgattaggaatgagaaagatggcattctgtgcccaattcctcagtaccccttgtactcggcctccatagctcttcatggtggagctcttgtcccctattaccttgatgaaaaaactgggtggggtttggaga

SEQ ID NO: 5782 - DNA, 272 bp, Zea mays
  Clone ID: 700042080H1
aaggatactatggagagtgtggtaaaagaggaggttacatggagattactggcttcagtgctccggtaagagagcagatctacaaggtagcttcagtgaacctgtgctccaatatcactggtcaaatccttgcgagcctcgtcatgaatccaccaaaggttggggacgaatcatatgcttcctacaaggcagagaaagatggaatccttcagtgtttagctcgccgtgcaaaggcactggaagatgcattcaacacgcttgagggattttca

SEQ ID NO: 5783 - DNA, 257 bp, Zea mays
  Clone ID: 700799695H1
ctggaatcatgtcacgtgatggattccctgcaaatgcagatgacattttcattacagacggagcaagtcctggggtccacatgatgatgcaattactgattaggaatgagaaagatggcattctgtgcccaattcctcagtaccccttgtactcagcctccatagctcttcatggtggagctcttgtcccctattaccttaatgaaaaaactgggtggggtttggagatctctgatcttaagatgcaactggaaaat

SEQ ID NO: 5784 - DNA, 294 bp, Zea mays
  Clone ID: 700347121H1
gaaagatggaatccttgagtctttagctcgtcgtgtaaaggcgttggaggatgcattcaacaagcttgagggactttcatgtaattaggccgaaggagcaatgtatcttttccctcagattcttctgccacagaaggcaatcgaggctgctaaagctgctaagaaagcgcctgacgctttctacgctctccgtctccttgaatcgactggaatcgtcgtggtccctggatctggatttggtcaagttcctggaacattgcacatcagatgcacgatcctgcgcgcagaagacaa

SEQ ID NO: 5785 - DNA, 264 bp, Zea mays
  Clone ID: 700194649H1
aagaaatttaactctttcaagaagattgtaagatccatggggtatggcgaggatgatctccctctagtatcgttacagtctgtttccaaaggatactatggagagtgtggtaaaagaggagggtacatggagattactggcttcagtactccagtaagagagcagatctacaagatagcttcagtgaacctgtgctccaatatcactggtcaaatccttgcgagcctcgtcatgaatccaccaaaggttggagacgaatcctat

SEQ ID NO: 5786 - DNA, 315 bp, Zea mays
  Clone ID: 700803015H1
gggacgcggcctgttgtcccggcttttagacgcaacttccatcgctgcgaagtatccattcgtgttcgtcatggccgccagcgtcaccgtggaaaacctcaaccccaaggtcttaaaatgtgagtatgcagtccgtggggagattgtcatccatgctcagcgcctgcagcaacaactacaaacacaaccagggtctcttccttttgatgagatcctctattgcaacattgggaatccccaatctcttggtcagcaacctgtgacattcttcagggaggttcttgctctttgtgatcatccgtgcctcttggaaaa

SEQ ID NO: 5787 - DNA, 247 bp, Zea mays
  Clone ID: 700046202H1
aatgagggccttgttcttctagctgatgaggtatatcaagagaacatctatgttgacaacaagaaatttaactctttcaagaagattgcaagatccatgggatacggcgaggatgatctccctctagtatcatttcagtctgtctccaaaggatactatggagagtgtggtaaaagaggaggttacatggagattactggcttcagtgctccggtaagagagcagatctacaaggtagcttcagtga

SEQ ID NO: 5788 - DNA, 318 bp, Zea mays
  Clone ID: 700621382H1
gtaacaaggctgaaggagcaatgtaccttttccctcagatccatctgccacataaggcaattgaggctgctaaagctgccaagaaagcacctgatgcattctatgcgctccgtctccttgaatcaactggaattgttgtggttcctagatctggatttggccaagttcctggaacatggcacgtcagatgcacgatcctgccgcaggaagataaaatccccgcggtgatcacccgcttcaaggctttccatgaggcgttcatggctgagtaccgtgactgaactgttacagtggctgagtaccacgtgtagacgaaac

SEQ ID NO: 5789 - DNA, 246 bp, Zea mays
  Clone ID: 700194809H1
gtacatggagattactggcttcagtgctccagtaagagagcagatctacaagatagcttcagtgaacctatgctccaatatcactggtcaaatccttgcgagcctcgtcatgaatccaccaaaggttggagacgaatcatatgcttcctacaaggcagagaaagatggaatccttgagtctttagctcgtcgtgcaaaggcgttggaggatgcattcaacaagcttgagggattttcatgtaacaa

SEQ ID NO: 5790 - DNA, 252 bp, Zea mays
  Clone ID: 700194576H1
ccccaatctcttggtcagcaacctgtgacattcttcagggaggttcttgctctttgtgatcatccgtgcctcttggaaaaagaggaaaccaaatcattgttcagtgctgatgcaatttctcgagcaaagcagattcttgcaactattcctggaagggcaacaggtgcatatagtcacagtcagggtatcaaaggactgcgtgatgcaattgctgctggaatcatgtcacgtgatggattccctgcaaatgca

SEQ ID NO: 5791 - DNA, 253 bp, Zea mays
  Clone ID: 700045006H1
gccgtgcaaaggcactggaagatgcattcaacacgcttgagggattttcatgtaacaaggctgaaggagcaatgtaccttttccctcagatccatctgccacataaggcaattgaggctgctaaagctgccaagaaagcacctgatgcattctatgcgctccgtctccttgaatcaactggaattgttgtggttcctggatctggatttggccaagttcctggaacatggcacgtcagatgcacgatcctgcc

SEQ ID NO: 5792 - DNA, 245 bp, Zea mays
  Clone ID: 700195835H1
gagaacatctatgtggacaacaagaaatttaactctttcaagaagattgtaagatccatggggtatggcgaggatgatctccctctagtatcgttacagtctgtttccaaaggatactatggagagtgtggtaaaagaggagggtacatggagattactggcttcagtactccagtaagagagcagatctacaagatagcttcagtgaacctgtgctccaatatcactggtcaaatccttgcgag

SEQ ID NO: 5793 - DNA, 248 bp, Zea mays
  Clone ID: 700194814H1
tccgtggaaaacctcaaccccaaggtcttaaaatgtgagtatgcagtccgtggggagattgtcatccatgctcagcgcctgcagcaacaactacaaacacaaccagggtctcttccttttgatgagatcctctattgcaatattgggaatccccaatctcttggtcagcaacctgtgacattcttcagggaggttcttgctctttgtgattatccgtgcctcttggaaaaagaggaaaccaaatcatt

SEQ ID NO: 5794 - DNA, 234 bp, Zea mays
  Clone ID: 700046245H1
aaaggatactatggagagtgtggtaaaagaggaggttacatggagattactggcttcagtgctccggtaagagagcagatctacaaggtagcttcagtgaacctgtgctccaatatcactggtcaaatccttgcgagcctcgtcatgaatccaccaaaggttggggacgaatcatatgcttcctacaaggcagagaaagatggaatccttcagtctttagctcgccgtgcaaag

SEQ ID NO: 5795 - DNA, 231 bp, Zea mays
  Clone ID: 700161109H1
aattcctcagtaccccttgtactcggcctccatagctcttcatggtggagctcttgtcccctattaccttgatgaaaaaactgggtggggtttggagatctctgatcttaagaaacaactcgaagatgctcggtcaaaaggcattgatgttagggccttggtggttatcaatccaggaaatccgactgggcaggttcttgctgaagacaaccaatatgatatagtgaaatt

SEQ ID NO: 5796 - DNA, 244 bp, Zea mays
  Clone ID: 700194345H1
catggagattactggcttcagtgctccagtaagagagcagatctacaagatagcttcagtgaacctatgctccaatatcactggtcaaatccttgcgagcctcgtcatgaatccaccaaaggttggagacgaatcatatgcttcctacaaggcagagaaagatggaatccttgagtctttagctcgtcgtgcaaaggcgttggaggatgcattcaacaagcttgagggattttcatgtaacaag

SEQ ID NO: 5797 - DNA, 283 bp, Zea mays
  unsure (1)...(283): unsure at all n locations
  Clone ID: 700472892H1
aaatcattgttcagtgctgatgcaatttctcgagcanagcagattcttgcaactattcctggaagggcaacaggtgcatatagtcacagtcagggtatcaaaggactgcgtgatgcaattgctgctggaatcatgtcacgtgatggattcctgcaaatgcagatgacattttcattacagacggagcaagtcctggggtccacatgatgatgcaattactgattaggaatgaggaagatggcatgatgaccctacntctcagtacctttgtatcagctccata

SEQ ID NO: 5798 - DNA, 241 bp, Zea mays
  Clone ID: 700617757H1
cttgtcccctattaccttaatgaaaaaactgggtggggtttggagatctctgatcttaagatgcaactggaaaatgctcggtcaaaaggcattgatgttagggcctgcgtggttatcaatccaggaaatccgactgggcaggttcttgctgaagacaaccaatatgatatagtgaaattctgcaaaaatgagggccttgttcttctagctgatgaggtatatcaagagaacatctatgtgg

SEQ ID NO: 5799 - DNA, 264 bp, Zea mays
  Clone ID: 700805426H1
ctcgagccgctcgagccgcttcagtgctccagtaagagagcagatctacaagatagcttcagtgaaccatgctccaatatcactggtcaaatccttgcgagcctcgtcatgaatccaccaaaggttggagacgaatcatatgcttcctacaaggcagagaaagatggaatccttgagtctttagctcgtcgtgcaaaggcgttggaggatgcattcaacaagcttgagggattttcatgtaacaagtccgaaggagcaatgtat

SEQ ID NO: 5800 - DNA, 256 bp, Zea mays
  Clone ID: 700801191H1
ctcgagccgtggaaaaagaggaaaccaaatcattgttcagtgctgatgcaatttctcgagcaaagcagattcttgcaactattcctggaagggcaacaggtgcatatagtcacagtcagggtatcaaaggactgcgtgatgcaattgctgctggaatcatgtcacgtgatggattccctacgaatgcagatgacattttcattacagacggagcaagtcctggggtccacatgatgatgcaattactgattaggaa

SEQ ID NO: 5801 - DNA, 284 bp, Zea mays
  Clone ID: 700472860H1
atatcattgttcagtgctatgcaatttctcgagcaaagcagattcttgctactattcctggaacggcaacaggtgcatatagtcacagtcagggtatcaaaggactgcgtgatgcaattgctgctggaatcatgtcacgtgatggattccatgcaaatgcagatgacattttcattacagacggagcaagtcctggggtccacatgatgatgcaattactgattaggaatgagacagatggcattctgtgcccattcctcagtaccctttgtatcacctccata

SEQ ID NO: 5802 - DNA, 297 bp, Zea mays
  Clone ID: 700100107H1
gacgcggcccgttgtcctcggcttgtacgcaatccttccgtcgctgcgaagtgatccctcgtgttcgccatggccacctacgtcgccgtggaaaacctataccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaagttcttgctctttgtgatcat

SEQ ID NO: 5803 - DNA, 292 bp, Zea mays
  Clone ID: 700465264H1
cattgggaatcctcaatcccttggtcagcaacctgtgacgttcttcagggaggtatgcaactttacctgcagattccacctttgtttcttcgatatttacatggtaccttgcaggttcttgctctttgtgatcatccatgcctcttggaaaaagaggaaaccaaatcattgttcagtgctgatgctatttctcgagcaaagcagattcttgcaactattcctggacgggcaacaggtgcatatagtcacagtcagggtatcaaaggattgcgtgatgcaattgctgctggga

SEQ ID NO: 5804 - DNA, 260 bp, Zea mays
  Clone ID: 700455079H1
ccaaggtcttaaaatgtgagtatgcagtccgtggggagattgtcatccatgctcagcgcctgcagcaacaactacaaacacaaccagggtctcttccttttgatgagatcctctattgcaacattgggaatccccaatctcttggtcagcaacctgtgacattcttcagggaggttcttgctctttgtgatcatccgtgcctcttggaaaaagaggaaaccaaatcattgttcagtgctgatgcaatttctcgagcaaag

SEQ ID NO: 5805 - DNA, 320 bp, Zea mays
  Clone ID: 700620492H1
aggcaattgaggctgctaaagctgccaagaaagcacctgatgcattctatgcgctccgtctccttgaatcaactggaattgttgtggttcctggatctggatttggccaagttcctggaacatggcacgtcagatgcacgatcctgccgcaggaagataaaatcccccggtgatcacccgcttcaaggctttccatgaggcgttcatggctgagtaccgtgactgaactgttacagtggctgagtaccaccgtgtagaccgaaacaaaataaagctcccccctctctctgtgtctgtgcgtgtgtgtgaactgatctctg

SEQ ID NO: 5806 - DNA, 288 bp, Zea mays
  Clone ID: 700801419H1
cgcggcctgttgtcccggcttttagacgcaacttccatcgctgcgaactatccattcgtgttcgtcatggccgccagcgtcaccgtggaaaacctcaaccccaaggtcttaaaatgtgagtatgcagtccgtggggagattgtcatccatgctcagcgcctgcagcaacaactacaaacacaaccagggtctcttccttttgatgagatcctctattgcaacattgggaatccccaatctcttggtcagcaacctgtgacattcttagggaggttcttgctctttgtg

SEQ ID NO: 5807 - DNA, 214 bp, Zea mays
  Clone ID: 700155082H1
ccacgcgtccggagaaagatggcattctgtgcccaattcctcagtaccccttgtactcggcctccatagctcttcatggtggagctcttgtcccctattaccttgatgaaaaaactgggtggggtttggagatctctgatcttaagaaacaactcgaagatgctcggtcaaaaggcattgatgttatggccttggtggttatcaatccaggaaa

SEQ ID NO: 5808 - DNA, 244 bp, Zea mays
  Clone ID: 700045844H1
aggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcggggatgatctccctctagaaccattcagtctgtctccaaggatactatggagagtgtggtaaaagaggagg

SEQ ID NO: 5809 - DNA, 283 bp, Zea mays
  Clone ID: 700477823H1
ggctgctaaagctgctaagaaagcgcctgacgctttctacgctctccgtctccttgaatcgactggaatcgtcgtggtccctggatctggatttggtcaagttcctggaacatggcacatcagatgcacgatcctgccgcaggaagacaagatccccgcggtgatcagccgcttcagggctttccatgaggcgttcttggccgaataccgcgactaaactgttacgctgtgtgtgagttaagttggaggttcagtagaactgtagaagagctcagtgacagcg

SEQ ID NO: 5810 - DNA, 271 bp, Zea mays
  Clone ID: 700475452H1
gcggcctgttgtcccggcttttagacgcaacttccatcgctgcgaactatccattcgtgttcgtcatggccgccagcgtcaccgtggaaaacctcaaccccaaggtcttaaaatgtgagtatgcagtccgtggggagattgtcatccatgctcagcgtctgcagcaacaactacaaacacaaccagggtctcttccttttgatgagatcctctattgcaacattgggaatccccaatctcttggtcatcaacctgtgacattcttcaggga

SEQ ID NO: 5811 - DNA, 210 bp, Zea mays
  Clone ID: 700802280H1
ctggcttcagtgctccggtaagagagcagatctacaaggtagcttcagtgaacctgtgctccaatatcactggtcaaatccttgcgagcctcgtcatgaatccaccaaaggttggggacgaatcatatgcttcctacaaggcagagaaagatggaatccttcagtctttagctcgccgtgcaaaggcactggaagatgcattcaacacgc

SEQ ID NO: 5812 - DNA, 182 bp, Zea mays
  Clone ID: 700156653H1
cttgtactcagcctccatagctcttcatggtggagctcttgtcccctattaccttaatgaaaaaactgggtggggtttggagatctctgatcttaagatgcaactggaaaatgctcggtcaaaaggcattgatgttagggctttggtggttatcaatccaggaaatccgactgggcaggttc

SEQ ID NO: 5813 - DNA, 281 bp, Zea mays
  Clone ID: 700444754H1
cgaaccgcactgtgagatagggacgctgactgttgtctcggcttttagacgcaacttccatcgctgcgagtatccattcgtgttcgtcatggccgccagcgtcaccgtggaaaacctcaaccccaaggtcttaaaatgtgagtatgcagtccgtggggagattgtcatccatgctcagcgcctgcagcaacaactacaaacacaaccagggtctcttccttttgatgagatcctctattaaaatattgggaatccccaatctcttggtcagcaaccagtga

SEQ ID NO: 5814 - DNA, 289 bp, Zea mays
  Clone ID: 700099483H1
attcgccacgaagccgcactgtgagagagggacgcggcccgttgtcctcggcttgtacgcaatccttccgtcgctgcgaactgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctg

SEQ ID NO: 5815 - DNA, 306 bp, Zea mays
  Clone ID: 700101871H1
caaacatctggtttcgctgccccgattcgccacgaagccgcactgtgagagagggacgcggcccgttgtcctcggcttgtacgcaatccttccgtcgctgcgaactgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcag

SEQ ID NO: 5816 - DNA, 272 bp, Zea mays
  Clone ID: 700076559H1
cccacgcgtccgagccgcactgtgagatatggacgcggcctgttgtcccggcttttagacgcaacttccatcgctgcgaactatccattcgtgttcgtcatggccgccagcgtcaccgtggaaaacctcaaccccaaggtcttaaaatgtgagtatgcagtccgtggggagattgtcatccatgctcagcgcctgcagcaacaactacaaacacaaccagggtctcttccttttgatgagatcctctattgcaatattgggaatccccaatc

SEQ ID NO: 5817 - DNA, 293 bp, Zea mays
  Clone ID: 700442606H1
ctggtttcgctgccccgattcgccacgaagccgcactgtgagagagggacgcggcccgttgtcctcggcttgtacgcaatccttccgtcgctgcgaactgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatccctt

SEQ ID NO: 5818 - DNA, 264 bp, Zea mays
  Clone ID: 700800871H1
gccgcactgtgagagagggacgcggcctgttgtcccggcttttagacgcaacttccatcgctgcgaactatccattcgtgttcgtcatggccgccagcgtcaccgtggaaaacctcaaccccaaggtcttaaaagtgagtatgcagtccgtggggagattgtcatccatgctcagcgcctgcagcaacaactacaaacacaaccagggtctcttccttttgatgagatcctctattgcaatattggggatccccaatctcttgg

SEQ ID NO: 5819 - DNA, 238 bp, Zea mays
  Clone ID: 700197582H1
agttcctggaacatagcacatcagatgcacgatcttgtcttcctgcggcaggatcgtgcatctgatgtgccatgttccaggaacttgacgaaatccagatccagggaccacgacgattccagttgattcaaggagacggagagtgtagaaagcgtcaggcgctttcttagcagctttagcagcctcgattgccttctgtggcagatgaatctgagggaaaactagttctagatcgcga

SEQ ID NO: 5820 - DNA, 306 bp, Zea mays
  Clone ID: 700100451H1
ctggtttcgctgccccgattcgccacgaagccgcactgtgagagagggacgcggcccgttgtcctcggcttgtacgcaatccttccgtcgctgcgaagtgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctg

SEQ ID NO: 5821 - DNA, 289 bp, Zea mays
  Clone ID: 700405018H1
ctggatctggatttggccaagttcctggaacatggcacgtcagatgcacgatcctgccgcaggaagataaaatccccgcggtgatcacccgcttcaaggctttccatgaggcgttcatggctgagtaccgtgactgaactgttacagtggctgagtaccaccgtgtagaccgaaacaaaataaagctcccccctctctctgtgtctgtgcgtgtgtgtgaactgatctctgaatggacgaacaatgtactctgttggcgcctttaatggcaattgaggaaattttgatc

SEQ ID NO: 5822 - DNA, 306 bp, Zea mays
  Clone ID: 700099885H1
cggacgcgtgggtctggtttcgctgccccgattcgccacgaagccgcactgtgagagagggacgcggcccgttgtcctcggcttgtacgcaatccttccgtcgctgccaactgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatccctt

SEQ ID NO: 5823 - DNA, 263 bp, Zea mays
  Clone ID: 700043273H1
cttgaatcaactggaattgttgtggttcctggatctggatttggccaagttcctggaacatggcacgtcagatgcacgatcctgccgcaggaagataaaatccccgcggtgatcacccgcttcaaggctttccatgacgcgctcatggctgagtaccgtgactgaactgttacagtggctgagtaccaccgtgcacaccgaaacaaaataaagctcccccctctctctgtgtctgtgcgtgtgtgtgaactgatctctgaatg

SEQ ID NO: 5824 - DNA, 293 bp, Zea mays
  Clone ID: 700476434H1
atctggtttcgctgccccgattcgccacgaagccgcactgtgagacagggacgcggcccgttgtcgtcggcttgtacgcaatccttccgtcgctgcgaactgatccctcgtgttcgccatggcccccagcgtcgccgtggaaaacctcaaccccaaggtcttgaaatgtgagttgcagtccgtggcgagattgtcatccatgctcagcgcttgcagcaacaactacaaacacaaccagggtctcttccttttgatgagacctgttctgcaacattgggatcctcaatccttgg

SEQ ID NO: 5825 - DNA, 267 bp, Zea mays
  Clone ID: 700438820H1
ggtttcgctgccccgattagccacgaagccgcactgtgagatagggacgcggcccgttgtcctcggcttgtacgcaatccttccgtcgctgcgaactgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgc

SEQ ID NO: 5826 - DNA, 263 bp, Zea mays
  unsure (1)...(263): unsure at all n locations
  Clone ID: 700428681H1
cgtgaatcaactggaattgttgtggttcctggatctggatttagccaagttcctggaacatggcacgtcagatgcacgatcctgccgcaggaagacaaaatccccgcggtgatcacccgcttcaaggctttccatgagacgttcatggctgagtaccgtaagtgnactgttacagtgtctgagtaccatcgtgtagaccgaaacaaaataaagctccactctctctctctctgtctctgtgcgtgtgtgtgaactgatctctg

SEQ ID NO: 5827 - DNA, 170 bp, Zea mays
  Clone ID: 700042259H1
gtcatgaatccaccaaaggttggggacgaatcatatgcttcctacaaggcagagaaagatggaatccttcagtctttagctcgccgtgcaaaggcactggaagatgcattcaacacgcttgagggattttcatgtaacaaggctgaaggagcaatgtactttttccctca

SEQ ID NO: 5828 - DNA, 285 bp, Zea mays
  Clone ID: 700801436H1
ctcgagccgacttcggctcgagatcgactggaatcgtcgtggtcactggatctggatttagtcaagttcctggaacatgacacatcagatgcacgatcctgccgcaggaagacaagatccccgcggtgatcagccgcttcagggctttccatgaggcgttcttggccgaataccgcgactaaactgttacgctgtgtgtgagttaagttggaggttcagtagaactgtagaagagctcagtgacagcgcagaaagaggcagtgtagaaaggcttaggtccttctt

SEQ ID NO: 5829 - DNA, 226 bp, Zea mays
  Clone ID: 700257814H1
ctggaatcgtcgtggtccctggatctggatttcgtcaagttcctggaacatggcacatcagatgcacgatcctgccgcagaagacaagatccccgcggtgatcagccgcttcagggctttccatgaggcgttcttggccgaataccgcgactaaactgttacgctgtgtgtgagttaagttggaggttcagtagaactgtagaagagctcagtgacagcgcagaaa

SEQ ID NO: 5830 - DNA, 261 bp, Zea mays
  Clone ID: 700044879H1
atctggtttcgctgccccgattcgccacgaagccgcactgtgagagagggacgcggcccgttgtcctcggcttgtacgcaatccttccgtcgctgcgaactgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagat

SEQ ID NO: 5831 - DNA, 319 bp, Zea mays
  Clone ID: 700207027H1
cgctcccggaccaccttttataagcaccaaccatctggccttgccgcgccgattcgccacgaagccgcactgtgagagagggacgcggcctgttgtcccggcttttagacgcaacttccatcgctgcgaactatccattcgtgttcgtcatggccgccagcgtcaccgtggaaaacctcaaccccaaggtcttaaaatgtgagtatgcagtccgtggggagattgtcatccatgctcagcgcctgcagcaacaactacaaacacaaccagggtctcttccttttgatgagatctcctatgcaatttgggaatcccaatc

SEQ ID NO: 5832 - DNA, 154 bp, Zea mays
  unsure (1)...(154): unsure at all n locations
  Clone ID: 700257265H1
aagaaatttaacgctttcaagaagattgcaagatccatgggatacggcgaggatgatcggcctctagtatcatttcagtctgtctccanaggatactatggagagtgtggtaaaagaggaggttacatggagattacgcngttcagtgctccgg

SEQ ID NO: 5833 - DNA, 136 bp, Zea mays
  Clone ID: 700571949H1
tgaattgttgtggttcctggatctggatttggccaagttcctggaacatggcacgtcagatgcacgatcctgccgcaggaagataaaatccccgcggtgatcacccgcttcaaggctgtccatgaggcgttcatgg

SEQ ID NO: 5834 - DNA, 271 bp, Zea mays
  Clone ID: 701166609H1
cggaatcgacgaggtccctggatctggatttcgtcaagttcctgggacatggcacatcagatgcacgatcctgccgcaggaagacaagatccccgcggtgatcagccgcttcagggctttccatgaggcgttcttggccgaataccgcgactaaactgttacgctgtgtgtgagttaagttggaggttcagtagaactgtagaagagctcagtgacagcgcagaaagaggcagtgttagaaaggcttaggtccttcttcacaggagcaaca

SEQ ID NO: 5835 - DNA, 239 bp, Zea mays
  Clone ID: 701182932H1
gccgcaggaagacaaaatccccgcggtgatcgcccgcttcaaggctttccatgaggcgttcatggctgagtaccgtgactgaactgttacagtggctgagtaccatcgtgtagaccgaaacaaaataaagctccactctctctctctctgtctctgtgcgtgtgtgtgaactgatctctgaatggaagaacaatgtactctgttggcgcctttaatggcaattgaggaaaattttgatc

SEQ ID NO: 5836 - DNA, 242 bp, Zea mays
  Clone ID: 700281788H1
tcctgccgcacgaagataaaatccccgcggtgatcacccgcttcaaggctttccatgaggcgttcatggctgagtaccgtgactgaactgttacagtggctgagtaccaccgtgtagaccgaaacaaaataaagctcccccctctctctgtgtctgtgcgtgtgtgtgaactgatctctgaatggacgaacaatgtactctgttggcgcctttaatggcaattgaggaaaattttgatcaag

SEQ ID NO: 5837 - DNA, 242 bp, Zea mays
  Clone ID: 700151478H1
tctggtttcgctgccccgattcgccacgaagccgcactgtgagagagggacgcggcccgttgtcctcggcttgtacgcaatccttccgtcgctgcgaactgatccctcgtgttcgccatggcccccagcgtcgccgtggaaaacctcaaccccaaggccttgaaatgtgagtatgcagtccgtggcgagattgtcatccatgctcagcgcttgcagcaacaactacaaacacaaccagggtc

SEQ ID NO: 5838 - DNA, 251 bp, Zea mays
  Clone ID: 700423955H1
gtttcgctgccccgattcgccacgaagccgcactgtgagagcgggacgcggcccgttgtcctcggcttgtacgcaatccttccgtcgctgcgaactcgatccctcgtgttcgccatggcccccagcgtcgccgtggacaaccacaaccccaaggtcttgaaatgtgagtatgcagtccgtggccagattgtcatccatgctcagcgcctgcagcaacaactacgaacacaaccaaggtctcttccttttga

SEQ ID NO: 5839 - DNA, 138 bp, Zea mays
  Clone ID: 700472592H1
aaatcattgttcagtgctgatgcaatttctcgagcaaagcagattcttgcaactattcctggaagggaactagggcatatagtcgcagtctaggtatcaaaggactgcgtgatgcaattgctgctggaatcatgtcac

SEQ ID NO: 5840 - DNA, 125 bp, Zea mays
  Clone ID: 700621067H2
tagattcttgctgacgacaaccaatatgatatagtaacattctgtacaaatgacggacttgttcttctagctgatgacgtatatcaagagaacatctatattgactacaagaaatttaactcttt

SEQ ID NO: 5841 - DNA, 128 bp, Zea mays
  Clone ID: 700621082H2
atgcaattgatgctactaaagctgccaagaaagcacctgatgcattctatgcgctccgtctccttgaatcaactggaattgttgtagttcctggatctggatttggccaagttcctggaacatggcac

SEQ ID NO: 5842 - DNA, 98 bp, Zea mays
  Clone ID: 700426976H1
gtaggctgaaggagcaatgtaccttttccctcagatccatctgccacataaggcaattgaggctgataaagctgccaagaaagcacctgatgcattct

SEQ ID NO: 5843 - DNA, 99 bp, Zea mays
  Clone ID: 700098538H1
gacattttcattacagacggagcaaatcctggggtccacatgatgatgcaattactgattaggaatgagaaagatggcattctgtgcccaattcctcag

SEQ ID NO: 5844 - DNA, 307 bp, Zea mays
  Clone ID: 700263427H1
ggtggatacatcgaaatgacaaatcttcctccaaagacagtagatgagatctacaaggttgcatcaatagtactgagtccgaatgttcccgggcaaatctttatgggagtgatggttaaccctcctaaacctggagatatctcatacccgaagttcactgccgaaagcaagtccatcctcgaatctttgaggaggagagcgcgcatgatgacagacggtttcaacagctgccgaaatgtggtgtgcaatttcacagaaggagctatgtactctttcccccaaatacagctgccagcaagagccatcg

SEQ ID NO: 5845 - DNA, 287 bp, Zea mays
  Clone ID: 700222070H1
gccaataagcagggaggttcagcttgtttctttccacactgtgtccaaagggtactggggagagtgtggacaacgtggtggatacttcgaaatgacaaatcttcctccaaagacagtagatgagatctacaaggttgcatcaatagtactgagtccgaatgttcccgggcaaatctttatgggagtgatggttaaccctcctaaacctggagatatctcatacccgaagttcactgccgaaagcaagtccatcctcgaatctttgaggaggagagcgcgcatgatga

SEQ ID NO: 5846 - DNA, 287 bp, Zea mays
  Clone ID: 700085696H1
ctacaaggttgcatcaatagtactgagtccgaatgttcccgggcaaatctttatgggagtgatggttaaccctcctaaacctggagatatctcatacccgaagttcactgccgaaagcaagtccatcctcgaatctttgaggaggagagcgcgcatgatgacagacggtttcaacagctgccgaaatgtggtgtgcaatttcacagaaggagctatgtactctttcccccaaatacagctgccagcaagagccatcgaggcggcaaagagagccggcaaagcagcag

SEQ ID NO: 5847 - DNA, 427 bp, Zea mays
  Clone ID: LIB3060-001-Q1-K2-F11
gtgtggtaaaagaggaggttacatggagattactggcttcagtgctccggtaagagagcagatctacaaggtagcttcagtgaacctgtgctccaatatcactggtcaaatccttgcgagcctcgtcatgaatccaccaaaggtctgctattatggcattatgccctgattagaattaggaaacgccaaactgtccagttaaaacccattgcctcattcttcaggttggggacgaatcatatgcttcctacaaggcagagaaagatggaatccttcagtctttagctcgccgtgcaaaggttcgcctggttgcatttctactatagatttgagtaacttcctaaacatattcaaggtcttttttttggtcgttttacaggcactggaagatgcattcaacacgcttgagggattttcatgtaacaag

SEQ ID NO: 5848 - DNA, 341 bp, Zea mays
  unsure (1)...(341): unsure at all n locations
  Clone ID: LIB3060-042-Q1-K1-E6
ataagaaattatatcnnttttgaacctcgttcgtagcctacatcctcctttaattatccggtcgggccacacatccgagggccgccagcttcaccgttgaaatttctttccccaaggtcttaaaatgtgactatgcgatgggtttttaaattgtggtggatgctcagcgcctgcagcaacaactacaaacacaaccagagtctcttccttttgatgaaatcctctattgcaatattgggaatccccaatctcttggtcagcaacctgttacattcttcaaggaagttcttgctctttgtgattatccgtgcctcttggaaaaagaagaaaccaaatcattt

SEQ ID NO: 5849 - DNA, 139 bp, Zea mays
  Clone ID: LIB3067-007-Q1-K1-H12
gaaagatggcattctgttcccaattcctctttaccctttgtactcagccttcatagctctgcatggtggagctcttgtcccgtattaccttaatgaaaaaactgggtggggtttggagatctctgattttaatacgcat

SEQ ID NO: 5850 - DNA, 333 bp, Zea mays
  Clone ID: LIB3069-036-Q1-K1-C10
cccacgcgtccgcccacgcgtccgtttgtttccttcatgtcagagagggatggtatcctttcatcgttggctcggcgtgcaaaggctttggaagaagcattcaacagtttagaaggaattacatgcaacaaagccgaaggtgcaatgtatctgttcccacgccttcatttaccccagaaggcaattggagctgcccaagcagtcggcactgcgccagatgcatactacgcaaaacgcctactggaagccactggaatcgtcgtcgtccccggttctgggtttggacaggtccctggaacgtggcacttcaggtgcacgatactgccgcaggag

SEQ ID NO: 5851 - DNA, 416 bp, Zea mays
  Clone ID: LIB83-005-Q1-E1-A7
acggttctgggtttggacaggtccctggaacgtggcacttcaggtgcacgatactgccgcaggaggacaagatacctgcgatagtatccaggctcaaggagttccacgagaagttcatggatgaattccgtgattgagctgagtatccatcgccctggcgtgatttttatctgttcaaaataataatgctgccaattggttgcccccgctccctcgtcgtcccatggatgctacagccaaacaccatcccaaattgtgttacaggcagatccctatcgaaaaacctacagaatctcgggcactgcaatgccatggttctgtttgccttgtgagaagtgtatcaggctaggctctgagccctgatgtgtacaaacatacccgaactttgaaggcaatttgagttgtcccggggcatg

SEQ ID NO: 5852 - DNA, 435 bp, Zea mays
  Clone ID: LIB3060-015-Q1-K1-B3
gtgtgtttgtgtgtgtgtgtgtgtgcgcgcgcgcgcgcgcgtaggtggtggcgctgtgccaggctccgttcctgctcgacgatccccacgtcggcctcatgttcccggcggacgccatcgctagggccaagcactatctcgccatggcgcccggcggtctaggtgcgtacagtgactcccgcggcatcccgggaatcaggaaggaagttgccgacttcatccacaagcgtgatggatatcccagtgatccggaactcatctacctcacagactgtgccagcaaaggtgtgatgcagatcctgaacaccatcattagaaacgagatggacgggatcttggtccctgttcctcagtacccactttattccgccaccatttccctctatggtggttctctggtcccgtactacttggaagaagaggctaactggagcc

SEQ ID NO: 5853 - DNA, 361 bp, Zea mays
  Clone ID: LIB148-034-Q1-E1-A6
aaggcgcagtacgcggtgcgcggggagctgtacctccgcgcctccgagctccagaaggagggcaagaagattatcttcaccaacgtcgggcaaccgcacgccctcggccagaagccgctcaccttcccgcgccaggtggtggcgctgtgccaggctccgttcctcctcgatgaccccaatgtcggcctcatgttcccgcccgatgccatcgtgcgggccaagcgctatctcgccatggcgccgggaggtctaagtgcgtacagtgatgcccgtggtatccccggaatcaggaaggaagttgctgacttcatccacaagcgtgatggatatccgagtgatccagaactcatttacctcacag

SEQ ID NO: 5854 - DNA, 432 bp, Zea mays
  Clone ID: LIB3067-040-Q1-K1-B11
ggggtttggagatctctgatcttaagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgatctccctctagtatcatttcagtctgtctccaaaggatactatggagagtgtggtaaaagaggaggttacatggagattactggcttcagtgctccggtaagagagcagatctacaaggtagcttcagtgaacctgtgctccaatatcactggtcaaatccttg

SEQ ID NO: 5855 - DNA, 424 bp, Zea mays
  unsure (1)...(424): unsure at all n locations
  Clone ID: LIB3060-017-Q1-K1-F12
atcctgttctgcaacattgggaatcctcaatcccttggtcagcaacctgtgacgttcttcagggaggttcttgctctttgtgatcatccatgcctcttggaaaaagaggaaaccaaatcattgttcagtgctgatgctatttctcgagcaaagcagattcttgcaactattcctggacgggcaacaggtgcatatagtcacagtcagggtatcaaaggattgcgtgatgcaattgctgctgggatcacctcacgtgacggattccctgcaaatgcagatgacattttcattacagacggagcaagtcctgnggtccacatgatgatgcaattactgattaggaatgagaaagatggcattctgtgcccaattcctcagtaccccttgtactcggcctccatagctcttcatggtggagctcttg

SEQ ID NO: 5856 - DNA, 424 bp, Zea mays
  Clone ID: LIB143-053-Q1-E1-G9
taaacctgtgctccaaaatcactggtcaaatccttgcgagcctcgtcatgaatccaccaaaggttggggacgaatcatatgcttcctacaaggcagagaaagatggaatccttcagtctttagctcgccgtgcaaaggcactggaagatgcattcaacacgcttgagggattttcatgtaacaaggctgaaggagcaatgtaccttttccctcagatccatctgccacataaggcaattgaggctgctaaagctgccaagaaagcacctgatgcattctatgcgctccgtctccttgaatcaactggaattgttgtggttcctggatctggatttggccaagttcctggaacatggcacgtcagatgcacgatcctgccgcaggaagataaaatccccgcggtgatcacccgcttcaaggcttt

SEQ ID NO: 5857 - DNA, 404 bp, Zea mays
  Clone ID: LIB148-002-Q1-E1-B9
gaaagatggcattctgtgcccaattcctcagtaccccttgtactcggcctccatagctcttcatggtggagctcttgtcccctattaccttgatgaaaaaactgggtggggtttggagatctctgatcttaagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgatctccctctagtatcatttcagtctgtct

SEQ ID NO: 5858 - DNA, 424 bp, Zea mays
  Clone ID: LIB36-012-Q1-E1-B11
ggtggagctcttgtcctcagtaccccttgtactcggcctccatagctcttcatggtggagctcttgtcccctattaccttgatgaaaaaactgggtggggtttggagatctctgatcttaagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgatctccctctagtatcatttcagtctgtctccaaaggatactatggagagtgtggtaaaag

SEQ ID NO: 5859 - DNA, 417 bp, Zea mays
  Clone ID: LIB84-004-Q1-E1-F6
agaacatctatgttgacaacaagaaatttaactctttcaagaagattgcaagatccatgggatacggcgaggatgatctccctctagtatcatttcagtctgtctccaaaggatactatggagagtgtggtaaaagaggaggttacatggagattactggcttcagtgctccggtaagagagcagatctacaaggtagcttcagtgaacctgtgctccaatatcactggtcaaatccttgcgagcctcgtcatgaatccaccaaacgttggggacgaatcatatgcttcctacaaggcacagaaagatggaatccttcagtctttagctcgccgtgcaaaggcactggaagatgcattcaacacgcttgagggattttcatgtaacaacgctgaaagagcaatgtaccttttccctc

SEQ ID NO: 5860 - DNA, 456 bp, Zea mays
  Clone ID: LIB3066-019-Q1-K1-E9
cccacgcgtccgcaagtcctggggtccacatgatgatgcaattactgattaggaatgagagagatggcattctgtgcccaattcctcagtaccccttgtactcggcctccatagctcttcatggtggagctcttgtcccctattaccttgatgaaaaaactgggtggggtttggagatctctgatcttaagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgatctccctctagtatcatttcagt

SEQ ID NO: 5861 - DNA, 413 bp, Zea mays
  Clone ID: LIB3059-045-Q1-K1-G1
cagtccaggaaatccgactgggcaggttcttgctgaagacaaccaatatgatatagtgaaattctgcaaaaatgagggccttgttcttctagctgatgaggtatatcaagagaacatctatgtggacaacaagaaatttaactctttcaagaagattgtaagatccatggggtatggcgaggatgatctccctctagtatcgttacagtctgtttccaaaggatactatggagagtgtggtaaaagaggagggtacatggagattactggcttcagtgctccagtaagagagcagatctacaagatagcttcagtgaacctatgctccaatatcactggtcaaatccttgcgagcctcgtcatgaatccaccaaaggttggagacgaatcatatgcttcctacaaggcagaga

SEQ ID NO: 5862 - DNA, 419 bp, Zea mays
  Clone ID: LIB3059-014-Q1-K1-H7
catggagattactggcttcagtgctccagtaagagagcagatctacaagatagcggcggggaacctatgctccaatatcactggtcaaatccttgcgagcctcgtcatgaatccaccaaaggttggagacgaatcatatgcttcctacaaggcagagaaagatggaatccttgagtctttagctcgtcgtgcaaaggcgttggaggatgcattcaacaagcttgagggattttcatgtaacaaggccgaaggagcaatgtatcttttccctcagattcttctgccacagaaggcaatcgaggctgctaaagctgctaagaaagcgcctgacgctttctacgctctccgtctccttgaatcgactggaatcgtcgtggtccctggatctggatttggtcaaattcctggaacatggcaca

SEQ ID NO: 5863 - DNA, 431 bp, Zea mays
  Clone ID: LIB3060-044-Q1-K1-E2
gcaagatccatgggatacggcgaggatgatctccctctagtatcatttcagtctgtgtccgaaggatactatggagagtgtggtaaaagaggaggttacatggagattactggcttcagtgctccggtaagagagcagatctacaaggtagcttcagtgaacctgtgctccaatatcactggtcaaatccttgcgagcctcgtcatgaatccaccaaaggttggggacgaatcatatgcttcctacaaggcagagaaagatggaatccttcagtctttagctcgccgtgcaaaggcactggaagatgcattcaacacgcttgagggattttcatggtaacaggctgaaagagcaatgtaccttttccctcagatccatctgccacataaggcaattgaggctgctaaagctgccaagaaagcacctgatgc

SEQ ID NO: 5864 - DNA, 384 bp, Zea mays
  Clone ID: LIB3060-012-Q1-K1-C8
cggacgcgtgggtgctatttctcgagcaaagcagattcttgcaactattcctggacgggcaacaggtgcatatagtcacagtcagggtatcaaaggattgcgtgatgcaattgctgctgggatcacctcacgtgacggattccctgcaaatgcagatgacattttcattacagacggagcaagtcctggggtccacatgatgatgcaattactgattaggaatgagaaagatggcattctgtgcccaattcctcagtaccccttgtactcggcctccatagctcttcatggtggagctcttgtcccctattaccttgatgaaaaaactgggtggggtttggagatctctgatcttaagaaacaactcgaagatgctcggtcaaa

SEQ ID NO: 5865 - DNA, 407 bp, Zea mays
  Clone ID: LIB189-019-Q1-E1-D11
agcatttcagtctgtctccaaaggatactatggagagtgtggtaaaagaggaggttacatggagattactggcttcagtgctccggtaagagagcagatctacaaggtagcttcagtgaacctgtgctccaatatcactggtcaaatccttgcgagcctcgtcatgaatccaccaaaggttggggacgaatcatatgcttcctacaaggcagagaaagatggaatccttcagtctttagctcgccgtgcaaaggcactggaagatgcattcaacacgcttgagggattttcatgtaacaaggctgaaggagcaatgtaccttttccctcagatccatctgccacataaggcaattgaggctgctaaagctgccaagaaagcacctgatgcattctatgcgctccgtc

SEQ ID NO: 5866 - DNA, 416 bp, Zea mays
  unsure (1)...(416): unsure at all n locations
  Clone ID: LIB3059-014-Q1-K1-A8
cggacgcgtgggtattcctggacgggcaacaggtgcatatagtcacagtcagggtgatgaaaggattgcgtgatgcaattgctgctgggatcacctcacgtgacggattccctgcaaatgcagatgacattttcattacagacggagcaagtcctggggtccacatgatgatgcaattactgattaggaatgagaaagatggcattctgtgcccaattcctcagtaccccttgtactcggcctccatagctcttcatggtggagctcttgtcccctattaccttgatgaaaaaactggngtggggtttggagatctctgatcttaagaaacaactcgaagatgctcggtcaaaaggcattgatgttagggccttggtggttatcaatccaggaaatccgactgggcaggttcttgc

SEQ ID NO: 5867 - DNA, 382 bp, Zea mays
  Clone ID: LIB143-053-Q1-E1-G10
aaacactggtcaaatccttgcgagcctcgtcatgaatccaccaaaggttggggacgaatcatatgcttcctacaaggcatagaaagatggaatccttcagtctttagctcgccgtgcaaaggcactggaagatgcattcaacacgcttgagggattttcatgtaacaaggctgaaggagcaatgtaccttttccctcagatccatctgccacataaggcaattgaggctgctaaagctgccaagaaagcacctgatgcattctatgcgctccgtctccttgaatcaactggaattgttgtggttcctggatctggatttggccaagttcctggaacatggcacgtcagatgcacgatcctgccgcacgaagataaaatcccc

SEQ ID NO: 5868 - DNA, 422 bp, Zea mays
  Clone ID: LIB3059-006-Q1-K1-H5
cgactgggcaggttcttgctgaagacaaccaatatgatatagtgaaattctgcaaaaatgagggccttgttcttctagctgatgaggtatatcaagagaacatctatgtggacaacaagaaatttaactctttcaagaagattgtaagatccatggggtatggcgaggatgatctccctctagtatcgttacagtctgtttccaaaggatactatggagagtgtggtaaaagaggagggtacatggagattactggcttcagtgctccagtaagagagcagatctacaagatagcttcagtgaacttgtgctccaatatcactggtcaaatccttgcgagccttgtcatgaatccaccaaaggcttgggacgaatcatatgcttactacaagggagagaaaggatggaacccttgagtcttt

SEQ ID NO: 5869 - DNA, 444 bp, Zea mays
  Clone ID: LIB3060-023-Q1-K1-E6
ccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaggttcttgctctttgtgatcatccatgcctcttggaaaaagaagaaaccaaatcattgttcagtgctgatgcctattctcgagccaagcaaattcttggcactattcctggaccggccacaagtgcctatagtcacaagcagggtattaaaagattgcctgattcaattgctgcttggatcaccttacgtgacggattccctgcaaatgccaatgacattttcattacagaccgagcaagtcctggggtccacatgatgatgcaattactga

SEQ ID NO: 5870 - DNA, 428 bp, Zea mays
  Clone ID: LIB36-017-Q1-E1-D3
ggaatccttcagtctttagctcgccgtgcaaaggcactggaagatgcattcaacacgcttgagggattttcatgtaacaaggctgaaggagcaatgtaccttttccctcagatccatctgccacataaggcaattgaggctgctaaagctgccaagaaagcacctgatgcattctatgcgctccgtctccttgaatcaactggaattgttgtggttcctggatctggatttggccaagttcctggaacatggcacgtcagatgcacgatcctgccgcaggaagataaaatccccgcggtgatcacccgcttcaaggctttccatgaggcgttcatggctgagtaccctgactgaactgttacagtggctgagtatcaacgtgttgaccgaaacaaaataaagctcccccctccctctgtgtccgtgcg

SEQ ID NO: 5871 - DNA, 293 bp, Zea mays
  Clone ID: LIB3060-023-Q1-K1-E7
ccaagggcttgaaatgtgagtatgctttcctttgcgagattgtcatccatgctcagcgcttgcgtcaacatctacaaacacaaccagggtctcttccttttgatgagatcctgttctgcaacattgggaatcctcaatcccttggtcagcaacctgtgacgttcttcagggaggttcttgctctttgtgatcatccatgcctcttggaaaaagaggaaaccaaatcattgttcagtgctgatgctatttctcgagcaaagcagattcttgcaactattcctggacgggcaaca

SEQ ID NO: 5872 - DNA, 430 bp, Zea mays
  Clone ID: LIB3060-036-Q1-K1-D2
cggacgcgtgggcggacgcgtgggcgaagccgcactgtgagagagggacgcggccggttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaggttcttgctctttgtgatcatccatgcctcttggaaaaagaggaaaccaaatcattgttcagtgctgatgctatttctcgagcatagcagattcttgcaactattcc

SEQ ID NO: 5873 - DNA, 424 bp, Zea mays
  Clone ID: LIB3060-002-Q1-K2-C11
gtttcgctgccccgattcgccacgaagccgcactgtgagagagggacgcggcccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaggttcttgctctttgtgatcatccatgcctcttggaaaaagaggaaaccaaatcattgttcagtgctgatgctatttctcgagctaagcagattcttgcaacta

SEQ ID NO: 5874 - DNA, 409 bp, Zea mays
  Clone ID: LIB36-013-Q1-E1-C3
tgaaggagcaatgtaccttttccctcagatccatctgccacataaggcaattgaggctgctaaagctgccaagaaagcacctgatgcattctatgcgctccgtctccttgaatcaactggaattgttgtggttcctggatctggatttggccaagttcctggaacatggcacgtcagatgcacgatcctgccgcaggaagataaaatccccgcggtgatcacccgcttcaaggctttccatgaggcgttcatggctgagtaccgtgactgaactgttacagtggctgagtaccaccgtgtagaccgaaacaaaataaagctcccccctctctctgtgtctgtgcgtgtgtgtgaactgatctctgaatggacgaacaatgtactctgttggcgcctttaatggcaattg

SEQ ID NO: 5875 - DNA, 497 bp, Zea mays
  unsure (1)...(497): unsure at all n locations
  Clone ID: LIB3079-021-Q1-K1-D8
agatgctntgactgagcatcgcatgtattgtattactctcgcgctgctgcataattgccgcgacgaaccactcctccgatgtaacacggctgaaggagcaatgtaccttttccctcagatccatctgccacagaagtcaattgaggctgctaaagctgccaagaaagcacctgatgcattctatgcgctccgtctccttgaatcaactggaattgttgtggttcctggatctggatttggccaagttcctggaacatggcacgtcagatgcacgatcctgccgcaggaagataaaatccccgcggtgatcacccgcttcaaggctttccatgaggcgttcatggctgagtaccgtgactgaactgttacagtggctgagtaccaccgtgtagaccgaaacagaataaagctcccccctctctctgtgtctgtgcgtgtgtgtgaactgatctctgaatggacgaacaatgtactctgttggcgcctttaatggcaat

SEQ ID NO: 5876 - DNA, 417 bp, Zea mays
  Clone ID: LIB3060-051-Q1-K1-B8
tcgatctggtttcgttgacccgattcgccacgaagccgcactgcgagagagggacgcggtccgttgtcctgggattgtacgcaatccttccgtcgctgcgaagctgatccctcgtgtgcgccatggccgccagcgtcgacgtggaaaacctcgaccccaaggtcttgaaatgcgagtatgcagtccgcggcgagattgtcatccatgctcagcgctagcagctacaactacagacacaaccagggtctcttccttttgatgagatcctgttctgcaacattgggaatcctcaatcccttggtcagcaacctgtgacgctcttcaaggaggctcttgctctttgtgatcatccatgcctgttggaaaaagaggaaaccaattcattgctcagtgctgatgctatgcctcgagcaaagc

SEQ ID NO: 5877 - DNA, 344 bp, Zea mays
  Clone ID: LIB3059-048-Q1-K1-A4
cggacgcgtgggagctcttgtcccctattaccttgatgaaaaaactgggtggggtttggagatgtctgatcttaagaaacaactcgaagatgctcggtcaaaaggcattgatgttagggccttggtggttatcaatccaggaaatccgactgggcaggttcttgctgaagacaaccaatatgatatagtgaaattctgtaaaaatgagggccttgttcttctagctgatgaggtatatcaagagaacatctatgttgacaacaagaaatttaactctttcaagaagattgcaagatccatgggatacggcgaggatgaatctcctttaatatcatttcaatctg

SEQ ID NO: 5878 - DNA, 406 bp, Zea mays
  Clone ID: LIB3060-043-Q1-K1-G9
tggtttcgctgccccgattcgccacgaagccgcactgtgagagagggacgcggcccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcaaggaggttcttgctctttgtgatcatccatgcctcttggaaaaagaggaaaccaaatcattgttcagtgctgatgctatttctcgagc

SEQ ID NO: 5879 - DNA, 362 bp, Zea mays
  Clone ID: LIB3060-034-Q1-K1-A5
ctggtttcgctgccccgattcgccacgaagccgcactgtgagagagggacgcggcccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgacgttcttcagggaggttcttgctctttgtgatcatccatgcctcttgtaaaa

SEQ ID NO: 5880 - DNA, 264 bp, Zea mays
  Clone ID: LIB3060-042-Q1-K1-E4
atggccgccagcgtcaccgtggaaaacctcaaccccaaggtcttaaaatgtgagtatgcggtccgtggggagattgtcatccatgctcagcgcctgcagcaacaactacaaacacaaccagggtctcttccttttgatgagatcctctattgcaatattgggaatccccaatctcttggtcagcaacctgtgacattcttcagggaggttcttgctctttgtgattatccgtgcctcttggaaaaagaggaaaccaaatcattg

SEQ ID NO: 5881 - DNA, 414 bp, Zea mays
  Clone ID: LIB3060-011-Q1-K1-A9
cccgattcgccacgaagccgcactgtgagagagggacgcggcccgttgtcctcggcttgtacgcagtccttccgtcgctgcgaagctgatccctcgtgttcgccatggcccccagcgtcgccgtggaaaacctcaaccccaaggtcttgaaatgtgagtatgcagtccgcggcgagattgtcatccatgctcagcgcttgcagcaacaactacaaacacaaccagggtctctttcttttgatgagatcctgttctgcaacattgggaatcctcaatcccttggtcagcaacctgtgacgttctttagggaggttcttgctctttgtgatcatccatgcctcttggaaaaagaggaaaccaaatcatcgttcagtgctgatgctatttctcgagcacagcagattcttgcaacta

SEQ ID NO: 5882 - DNA, 288 bp, Zea mays
  Clone ID: LIB189-033-Q1-E1-F2
aaccaaacgtccgcattcgtgttcgtcatggccaccaacgtcaccgtggaaaacctcaaccccaaggtcttaaaatgtgagtatgcagtccgtggggagattgtcatccatgggcagcgcctgcagcaacaactacaaacacaggcagggtctcttccttttgatgagatcctctattgcaacattgggaatccccaatctcttggtcagcaacctgtgacattcttcaaggaagttcttgctctttgttatcatccgtgcctcttggaaaaagaggaaaccacatca

SEQ ID NO: 5883 - DNA, 308 bp, Zea mays
  Clone ID: LIB3061-041-Q1-K1-B2
gtttcgctgccccgattcgccacgaagccgcactgtgagagagggacgcggtccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgtggcgagattgtcatccatgctcagcgcttgcagcaacaactacaaacacaaccagggtctcttccttttgatgagatcctgttctgcaacattgggaatcctcaatcccttggtcagcaacctgtgac

SEQ ID NO: 5884 - DNA, 354 bp, Zea mays
  Clone ID: LIB3060-030-Q1-K1-E1
cgctgcgccgattcgccacgaagccgcactgttagatagggacgcggcccgttgtcctcggctggtacgcaatccttccgtcgctgcgaagctgatccctcgtgttcgccatggcccccagcgtcgccgtggaaaacctcaaccccaaggtcttggaatgggaatatgcagtccgtggcgagattgtaatccatgcttagcgcttgcagcaacaactacaaacacaaccagggtctcttccttttgatgagatccttgtttgcaccattgggaatcctaaatcccttggtcagcaaccttggacgttcttcagggaggttcttgctctttgggatcatccatgccttttggaaa

SEQ ID NO: 5885 - DNA, 262 bp, Zea mays
  Clone ID: LIB3060-004-Q1-K1-A8
ggtttcgctgccccgattcgccacgaagccgcactgtgagagagggacgcggcccgttgtcctcggcttgtacgcaatccttccgtcgctgcgaagctgatccctcgtgttcgccatggcccccagcgtcgccgtggaaaacctcaaccccaaggtcttgaaatgtgagtatgcagtccgaggcgagattgtcatccatgctcagcgcttgcagcgacaacgtcgaacacaaccagggtctcttacttttgatgagatcctg

SEQ ID NO: 5886 - DNA, 421 bp, Zea mays
  Clone ID: LIB3062-014-Q1-K1-A12
aaacttagttctgctagcagatgaagtgtatcaacagaacatttatcaagatgaacgggcatttataagcgcaagaaaggttatgttcgacatgggtccaccaataagcagtgagcttcaggttgtttctttccacactgtgtcgaaagggtactggggagagtgcggacaacgtggtggatacttcgaaatgacaaatcttcctcccaagacagtagatgagatctacaaggttgcatcgatagcactgagtccaaacgttcctgggcaaatttttatgggagtaatggttaaccctcctaaacctggagatatctcgtacctgaagttcgctgctgaaagcaagtccatccatgaatctttgaggaggagagcacgcatgatgacagatggtttcaacagttgccgaaacgtcgtgtgc

SEQ ID NO: 5887 - DNA, 403 bp, Zea mays
  Clone ID: LIB3060-041-Q1-K1-C8
gataaatccaggaaatcccactggccaatgccttagtgaagcgaatataaaggaacggctgcaattttgctaccgtgaaaacttagttctgctagcacatgaagtgtatcaacagaacatttatcaagatgaacggccatttataagcgcaagaaaggttatgttcgacatgggtccaccaataagcagtgagcttcaggttgtttctttccacactgtgtcgaaagggtactggggagagtgcggacaacgtggtggatacttcgaaatgacaaatcttcctgccaagacagtagatgagatctacaacgttgcatcgatagcactgagtccaaacgttcctgggcaaatttttatgggagtaatggttaaccctactaaacctggagatatcgtgtacctg

SEQ ID NO: 5888 - DNA, 383 bp, Zea mays
  Clone ID: LIB84-028-Q1-E1-H9
acgtggggagagtgtggacaacgtggtggatacttcgaaatgacaaatcttcctccaaagacagtagatgagatctacaaggttgcatcaatagtactgagtccgaatgttcccgggcaaatctttatgggagtgatggttaaccctcctaaacctggagatatctcataccccagttcactgccgaaagcaagtccatcctcgaatctttgaggaggagagcgcgcatgatgacagacggtttcaacagctgccgaaatgtggtgtgcaatttcacagaaggagctatgtactctttcccccaaatacagctgccagcaagagccatcgaggcggcaaagagagccggcaaagcagcagacgttttctactgcctcaagctc

SEQ ID NO: 5889 - DNA, 198 bp, Glycine max
  Clone ID: 700743719H1
gagcgagggatgatgactgatggattcaacagttgcagatgtgtggtttgtacattttactgagaggtgccatgtattcattccctcaaatacgcttgccgccaagagctttagaggctgctaaacaggctggagaggttccagatgtttactactgcctcgcgcttctggaggtcactggcgtatccgctgttcctg

SEQ ID NO: 5890 - DNA, 164 bp, Glycine max
  Clone ID: 700959696H1
gcaattactcattagatcagaaaatgatggtaatctgtgtcccattccacagtaccctctgtactcagcctcaattgccctccatggtggctgcctggtaccttattatctagatgaagcaactggctgggggttggaaatacctgaactcaagaagcaattgg

SEQ ID NO: 5891 - DNA, 269 bp, Glycine max
  unsure (1)...(269): unsure at all n locations
  Clone ID: 700996510H1
cccggattgttgttttttggttttnnacttctggccgtgctanagttgcaagctttgaaggctttnctattttaatctgggcatgngtgntgttgaattnatgngttctgaaatgtgagtatgctgttannggagaggttgtcacacttgcccagaatttgcaaaaggntttncaggcnaatccnggttctcacccattngatgaaatactttacngnaacattggaaatcctcagtcnctggggcagcagncataagttttttccgag

SEQ ID NO: 5892 - DNA, 212 bp, Glycine max
  Clone ID: 701069323H1
caaattagagggtgtaacatgcaacaaagcagaaggggcaatgtacctgttcccccaaattcgcctgtccgaaaaggctatcaaagctgcagaggctgcaaatgcaacacctgataacttctattgcaaacgcttgcttaatgccacaggagtcgttgttgttcctggttctggttttggacaggttcctggcacatgggcattttaggtgc

SEQ ID NO: 5893 - DNA, 259 bp, Glycine max
  Clone ID: 700605618H2
ctctccccattttctcgctctcgtttcttgtcctctactcctttctccatggcttctgattcccctttccctgtcaccgctcaaaacatcaaccccaaggttctgaaatgtgagtatgctgttagaggagaggttgtcacacttgcccagaatttgcaaaaggatttacaggccaatccaggttctcacccatttgatgagatactttactgcaacattggaaatcctcagtctctgggccagcagccaataacttttt

SEQ ID NO: 5894 - DNA, 272 bp, Glycine max
  Clone ID: 700682253H1
cctcaccatcataatcaccatccctttccttattcttcttctgtttcatccctctcaccattttctcgctctcgtttcttttcctctactcctttctccatggcttctgattcccctttccctgtcaccgctcaaaacatcaaccccaaggttctgaaatgtgagtatgctgttagaggagaggttgtcacacttgcccagaatttgcaaaaggatttacaggccaatccaggttctcacccatttgatgagatactttactgcaacattgg

SEQ ID NO: 5895 - DNA, 290 bp, Glycine max
  Clone ID: 700990421H1
ctgcagacagattcaggcaccttttcaaccgttcactcattcttctgcgccaccgtcaccatcaccatccctttccttcttcttcttctctctccccattttctcgctctcgtttcttctcctctacgccgttctccatggcttctgattccccttttcctgtcaccgctcaaaacatcaaccccaaggttctgaaatgtgagtatgctgttagaggagaggttgtcacacttgcccagaatttgcaaaaggatttacaggccaatccaggctctcacccatttgatgag

SEQ ID NO: 5896 - DNA, 272 bp, Glycine max
  Clone ID: 700747761H1
ttttcaaccgttcactcattcttctgcgccaccgtcaccatcaccatccctttccttcttcttcttctctctccccattttctcgctctcgtttcttctcctctacgccgttctccatggcttctgattccccttttcctgtcaccgctcaaaacatcaaccccaaggttctgaaatgtgagtatgctgttagaggagaggttgtcacacttgcccagaatttgcaaaaggatttacaggccaatccaggctctcacccatttgatgagata

SEQ ID NO: 5897 - DNA, 245 bp, Glycine max
  Clone ID: 701038703H1
catcaccatccctttccttattcttcttctgtttcatccctctccccattttctcgctctcgtttcttgtcctctactcctttctccatggcttctgattcccctttccctgtcaccgctcaaaacatcaaccccaaggttctgaaatgtgagtatgctgttagaggagaggttgtcacacttgcccagaatttgcaaaaggatttacaggccaatccaggttctcacccatttgatgagatact

SEQ ID NO: 5898 - DNA, 272 bp, Glycine max
  unsure (1)...(272): unsure at all n locations
  Clone ID: 700975277H1
cgttcactcattcttctgcgccaccgtcaccatcaccatccctttccttcttcttcttctctctccccattttctcgctctcgtttcttctcctctacgccgttctccatggcttctgattccccttttcctgtcaccgctcaaaacatcaaccccaaggttctgaaatgtgagtatgctgttagaggagaggttgtcacactttcccagaatttgcaaaaggatttacaggccaatccaggctctcacccattgatgagatnctttactgc

SEQ ID NO: 5899 - DNA, 282 bp, Glycine max
  Clone ID: 700984821H1
cagattcaggcaccttttcaaccgttcactcattcttctgcgccaccgtcaccatcaccatccctttccttcttcttcttctctctccccattttctcgctctcgtttcttctcctctacgccgttctccatggcttctgattccccttttcctgtcaccgctcaaaacatcaaccccaaggttctgaaatgtgagtatgctgttagaggagaggttgtcacacttgcccagaatttgcaaaaggatttacaggccaatccaggctctcacccatttgatgg

SEQ ID NO: 5900 - DNA, 253 bp, Glycine max
  Clone ID: 700756842H1
caaccgttcactcattcttctgcgccaccgtcaccatcaccatccctttccttcttcttcttctctctccccattttctcgctctcgtttcttctcctctacgccgttctccatggcttctgattcccctttcctgtcaccgctcaaaacatcaaccccaaggttctgaaatgtgagtatgctgttagaggagaggttgtcacacttgcccagaatttgcaaaaggatttacaggccaatccaggctctcacc

SEQ ID NO: 5901 - DNA, 236 bp, Glycine max
  Clone ID: 700746942H1
tttcaaccgttcactccttcttctgcgtcaccgtcaccatcttaatcaccatccctttccttattcttcttctgtttcatccctctccccattttctcgctctcgtttcttgtcctctactcctttctccatggcttctgattcccctttccctgtcaccgctcaaaacatcaaccccaaggttctgaaatgtgagtatgctgttagaggagaggttgtcacacttgcccagaatt

SEQ ID NO: 5902 - DNA, 285 bp, Glycine max
  Clone ID: 701120663H1
atgggatatggtgagaatgatatcaccttagtatcttttcaatcagtctccaaaggctatcacggggagtgtgggaaacgaggaggttatatggaggtgactgggttttctgcagaagtgagggaacaaatatataaagtggcatctgtcaacctttgctctaatatctctggtcaaattcttgcaagcttggtcatgagtccacccaaggttggagatgagtcctatgactcattcatggctgagaaggagaatattttggcgtcccttgccaggcgtgcaaag

SEQ ID NO: 5903 - DNA, 265 bp, Glycine max
  Clone ID: 701049525H1
atgggatatggtgagaatgatatcaccttagtatcttttcaatcagtctccaaaggctatcacggggagtgtgggaaacgaggaggttatatggaggtgactgggttttctgcagaagtgagggaacaaatatataaagtggcatctgtcaacctttgctctaatatctctggtcaaattcttgcaagcttggtcatgagtccacccaaggttggagatgagtcctatgacattcatggctgagaaggagaatattttggcgtcc

SEQ ID NO: 5904 - DNA, 266 bp, Glycine max
  Clone ID: 701119423H1
aagaaaacgtttatgttcctgagaagaaatttcactctttcaagaaggtatctcggtccatgggatatggtgagaatgatatcaccttagtatcttttcaatcagtctccaaaggctaccacggggagtgtgggaaacgaggaggttatatggaggtgactgggttttctgcagaagtgagggaacaaatatataaagtggcatctgtcaacctttgctctaatatctctggtcaaattcttgctagcttagtcatgagtcctcct

SEQ ID NO: 5905 - DNA, 220 bp, Glycine max
  Clone ID: 700872879H1
ggaggttatatggaggtgactgggttttctgcagaagtgagggaacaaatatataaagtggcatctgtcaacctttgctctaatatctctggtcaaattcttgcaagcttggtcatgagtccacccaaggttggagatgagtcctatgactcattcatggctgagaaggagaatattttggcgtcccttgccaggcgtgcaaagacattagaagatgcat

SEQ ID NO: 5906 - DNA, 262 bp, Glycine max
  unsure (1)...(262): unsure at all n locations
  Clone ID: 700973420H1
cgangaggttatatggaggtgactgggttttctgcagaagtgagggaacaaatntataaagtggcatctgtcaacctttgctctantatctctggtcaaattcttgctagcttantcatgagtcntcctaaggttgganatnagtcctangagtcattcaatgctganaaggagaatattttggagtcccttgctaggcgtgccaagacactagaagatgcatcaacaaattagagggtgtaacatgccacanancagaagg

SEQ ID NO: 5907 - DNA, 271 bp, Glycine max
  Clone ID: 700562950H1
aggatttacagggccaatccaggttctcacccatttgatgagatactttactgcaacattggaaatcctcagtctctgggccagcagccaataacttttttccgagaggttcttgcattatgtgaccatccagctatattggacaaaagtgaaacacagggtttgttcagtactgatgcaatacagcgagcatggcagattgtggatcagattcctgggagagcaactggtgcctatagccatagtcagggtgtcaagggcttgcgtgata

SEQ ID NO: 5908 - DNA, 273 bp, Glycine max
  unsure (1)...(273): unsure at all n locations
  Clone ID: 700971319H1
tccagggctctcacccctttgatgnnatactttactgcaacattggaaatcctncagtctcttgngccagcagccaataacttttttccgagangttcttgcattatgtgaccatccagctatattagacaaaagtgaaacacagggtttgttcagtaccgacgcaatacagcgagcttggcanattgtggatcagattcctgggagagcaactggtgcctatagccatagtcagggtgtcaagggcttgcgtgatacaatagctgctggaat

SEQ ID NO: 5909 - DNA, 275 bp, Glycine max
  Clone ID: 700555074H1
aatcactgagaagaagagcaaggataatgactgatggattcaacagttgcagaaatgtggtttgtaattttactgaaggtgccatgtattcattccctcaaatacgcttgccgccaagagctttagaggctgctaaacaggctggaaaggttccagatgtttactactgcctcaagcttttggaagccactggcatatccactgttcctggttcaggatttggtcagaaagaaggggtgttccatttgaggacaactattttaccagctgaggaa

SEQ ID NO: 5910 - DNA, 276 bp, Glycine max
  Clone ID: 700555060H1
aatcactgagaagaagagcaaggataatgactgatggattcaacagttgcagaaatgtggtttgtaattttactgaaggtgccatgtattcattccctcaaatacgcttgccgccaagagctttagaggctgctaaacaggctggaaaggttccagatgtttactactgcctcaagcttttggaagccactggcatatccactgttcctggttcaggatttggtcagaaagaaggggtgttccatttgaggacaactattttaccagctgaggaag

SEQ ID NO: 5911 - DNA, 207 bp, Glycine max
  Clone ID: 700743751H1
tcggaaggataatgactgatggattcgacagttgcataaatgtggtttgtaattttactgaaggtgccatgtattcattccctcaaatacgcttgccgccaagagctttagaggctgctaaacaggctggaaaggttccagatgtttactactgcctcaagcttttggaagccactggcatatccactgttcctggttcaggatttg

SEQ ID NO: 5912 - DNA, 222 bp, Glycine max
  Clone ID: 700896952H1
gagtcctcctaaggttggagatgagtcctatgagtcattcaatgctgagaaggagaatattttggagtcccttgctaggcgtgccaagacactagaagatgcattcaacaaattagagggtgtaacatgcaacaaagcagaaggggcaatgtatctgttcccccaaattcgcctgtcccaaaaggctatcaaagctgcaggagatgcaaatacagcacctga

SEQ ID NO: 5913 - DNA, 263 bp, Glycine max
  unsure (1)...(263): unsure at all n locations
  Clone ID: 700659743H1
aaattcttgcaagcntggtcatgagtccacccaaggttggagatgagtcctatgactcattcatggctgagaaggagaatattttggcgtcccttgccaggcgtgcaaagacactagaagatgcattcaacaaattagagggtgtaacatgcaacaaagcagaaggggcaatgtaacgttcccccaaatnnngcctgtccgaaaaggctatcaaactgcagaggctgcaaatgcaacacctgataacttctattgcaaacgct

SEQ ID NO: 5914 - DNA, 242 bp, Glycine max
  Clone ID: 700874484H1
gacagagagaaggggtcttccatttgaggactactattttaccagacgaggaagacatgcccgctattatggatagtttcaaaaagttcaatgatgaattcatggagcaatacgaagacaatagaggttattcaaggttgtaagaaaattatcgtaaaagatgcattatactcttgtgcttttgtaagaaaaacataacctccctttctactatttgtccttggagataattcttaaacctt

SEQ ID NO: 5915 - DNA, 301 bp, Glycine max
  unsure (1)...(301): unsure at all n locations
  Clone ID: 701001504H1
ggatgcaatacagcgagcatggcagattgtggatcagattcctgggagagcnactggtgcctanaggcatagtccaggngtcaagggcttgcntgatacaatagctgctggaattgaagagcgtgatggttttcctgccaatcctgatgacattttcatgactgatggtgcaagccctgctgtccataatatgatgcaattactcattagatcagaaaatgatggtattctgtgtcccattccacagtaccctctgtactcagcctcaatgccctccatggtggctgcctggtacctatta

SEQ ID NO: 5916 - DNA, 249 bp, Glycine max
  unsure (1)...(249): unsure at all n locations
  Clone ID: 700969537H1
ttatgtgaccatccagctatattggacaanagtgaaacacggggtttgttcagtactgatgcnatacagcgagcatggcagattgtggatcagattcctgggagagcanctggtgcctatagccatagtcagggtgtcaagggcttgcgtgatacaatagctgctggaattgaagagcgtgatggttttcctgccaatcctgatgacattttcatgactgatggtgcaagccctgctgtccataatatg

SEQ ID NO: 5917 - DNA, 255 bp, Glycine max
  Clone ID: 700672092H1
ggtttgttcagtaccgacgcaatacagcgagcttggcagattgtggatcagattcctgggagagcaactggtgcctatagccatagtcagggtgtcaagggcttgcgtgatacaatagctgctggaattgaagagcgtgatggttttcctgccaatcctgatgacattttcatgacagatggtgcaagccctgcagtccataatatgatgcaattactcattagatcagaaaatgatggtatctgtgtcccattc

SEQ ID NO: 5918 - DNA, 227 bp, Glycine max
  Clone ID: 700961520H1
ggcagattgtggatcagattcctgggagagcaactggtgcctatagccatagtcagggtgttcagggcttgcgtgatacaatagctgctggaattgaagagcgtgatggttttcctgccaatcctgatgacattttcatgactgatggtgcaagccctgctgtccataatatgatgcaattactcattagatcagaaaatgatggtattctgtgtcccattccacac

SEQ ID NO: 5919 - DNA, 128 bp, Glycine max
  Clone ID: 701141195H1
gacattttcatgactgatggtgcaagccctgctgtccataatatgatgcaattactcattagatcagaaaatgatggtattctgtgtcccattccacagtacacacgacagcaagcctcaattgccct

SEQ ID NO: 5920 - DNA, 290 bp, Glycine max
  unsure (1)...(290): unsure at all n locations
  Clone ID: 700559647H1
cgtcaatcagttgagcaggctcgctttaaaggaataactgttaaagcaatggtgatcataaatcctggaaaccctactggtcaatgccttagtgaagctaatctaagagaggttttgcaattctgtnatcaagaaaatttagccttgcttggagatgaggtttaccagacaaatatatatcaggatgaacgacccttcattagttctagaaaggttttgatggacttggggccacctataagcaaggaagtccagcttatttcttttcactccgtgtcaaaaggttatta

SEQ ID NO: 5921 - DNA, 283 bp, Glycine max
  Clone ID: 700556715H1
gagacagcaaattggggtcttgatgttaatgaacttcgtcaatcagttgaacaggctcgctttaaaggaataactgttaaagcaatggtgatcataaatcctggaaaccctactggtcaatgccttagtgaagctaatctaagagaggttttgcaattctgctatcaagaaaatttagccttgcttggagatgaggtttaccagacgaatatatatcaggatgaacgacccttcatcagttctagaaaggttttgatggaattggggccacctataagcaagg

SEQ ID NO: 5922 - DNA, 293 bp, Glycine max
  Clone ID: 701001051H1
gactcccgtggccttccaggagtgaggaaggaagttgctgagttcatactcaggcgtgatggttatccaactgatccagagctcatatatctcactgatggtgcaagcaaaggagtgatgcagatattaaatactatcatcaggggtcaagacgatgggattttggttccagtcccacaatacccactctactcagcaacaattgctctgcttggtggtacccttgttccatactaccttgaagagacagcaaattggggtcttgatgttaatgaacttcgtcaatcagttga

SEQ ID NO: 5923 - DNA, 258 bp, Glycine max
  Clone ID: 700682468H2
cttgttccatactaccttgaagagacagcaaattggggtcttgatgttaatgaacttcgtcaatcagttgagcaggctcgctttaaaggaataactactaaagcaatggtgatcataaatcctggaaaccctactggtcaatgccttagtgaagctaatctaagagaggttttgcaattctgttatcagagcaatttagccttgcttggagatgaggtttaccagacaaatatatatcaggatgaacgacccttcatt

SEQ ID NO: 5924 - DNA, 269 bp, Glycine max
  Clone ID: 700973534H1
catactaccttgaagagacagcaaattggggtcttgatgttaatgaacttcgtcaatcagttgagcaggctcgctttaaaggaataactgttaaagcaatggtgatcataaatcctggaaaccctactggtcaatgccttagtgaagctaatctaagagaggttttgcaattctgttatcaagaaaatttagccttgcttggagatgaggtttaccagacaaatatatatcaggatgaacgaccctcattagttctagaaaggttttga

SEQ ID NO: 5925 - DNA, 255 bp, Glycine max
  Clone ID: 700874672H1
ctttaaaggaataactgttaaagcaatggtgatcataaatcctggaaaccctactggtcaatgccttagtgaagctaatctaagagaggttttgcaattctgctatcaagaaaatttagccttgcttggaatgaggtttaccagacgaatatatatcaggatgaacgacccttcatcagttctagaaaggttttgatggaattggggccacctataagcaaggaagttcagcttatttcttttcactctgtgtca

SEQ ID NO: 5926 - DNA, 233 bp, Glycine max
  Clone ID: 700893193H1
ctcactgatggtgccagcaagggggtgatgcagatattaaatactatcatcagaggtcaagacgatgggattttggttccagtcccacaatacccactctactcagcaacaattgctctgcttggtggtacccttgttccatactaccttgaagagacagcaaattggggtcttgatgttaatgaacttcgtcaatcagttgagcaggctcgctttaaaggaataactgttaa

SEQ ID NO: 5927 - DNA, 254 bp, Glycine max
  Clone ID: 700681610H1
cactgatggtgcaagcaaaggagtgatgcagatattaaatactatcatcaggggtcaagacgatgggattttggttccagtcccacaatacccactctactcagcaataattgctctgcttggtggtacccttgttccatactaccttgaagagacagcaaattggggtcttgatgttaatgaacttcgtcaatcagttgaacaggctcgctttaaaggaataactgttaaagcaatggtgatctaaatcctgg

SEQ ID NO: 5928 - DNA, 268 bp, Glycine max
  unsure (1)...(268): unsure at all n locations
  Clone ID: 701002246H1
gggtgatgcagatattaaatactatcatcagaggtcaagacgatgggattttggttccagtcccacaatacccactctactcagcaacaattgctctgcttggtggtacccttgttccatactaccttgaagagcacagcaaattggggtcttgatgttaatgaacttcgtcaatcagttgagcaggctcgctttaaaggaataactgttaaancaatggtgatcataaatncctgggaaaccctactggtcaatgccttagtgaagc

SEQ ID NO: 5929 - DNA, 260 bp, Glycine max
  Clone ID: 700956467H1
attgacctcgggcggtttaggcgcttatagtgactcccgcggccttccaggagtgaggaaggaagtggctgagttcatactcaggcgtgatggttatccaactgatccagaactcatatatctcactgatggtgccagcaagggggtgatgcagatattaaatactatcatcagaggtcaagacgatgggattttggttccagtcccacaatacccactctactcagcaacaattgctctgcttggtggtacccttgttc

SEQ ID NO: 5930 - DNA, 181 bp, Glycine max
  Clone ID: 700888645H1
cactgatggtgccagcaaggtggtgatgcagatattaaatactatcatcagacgtcaagacgatgggattttggatacagtcccacaatacccactctactcggcaacaattgctctgcttggtggtacccttgttccatactaccttgaagagacagcaaattggggtcttgatgttaat

SEQ ID NO: 5931 - DNA, 277 bp, Glycine max
  unsure (1)...(277): unsure at all n locations
  Clone ID: 701002201H1
gttgagcaggctcgctttaaaggaataactgttaaagcaatggtgatcataaatcctggaaaccctactggtcaatgccttagtgaagctaatctaagagaggttttgcaattctgttatcaagaaaatttagccttgcntggagatgaggttaccagacaatatatatccaggatgaacggacccttcattagttcctagaaaggttttgatggacttggggccacctataagccaaggagtccagcttatttcttttcactccgtgtcaaaaggt

SEQ ID NO: 5932 - DNA, 155 bp, Glycine max
  Clone ID: 700680675H1
atccaactgatccagaactcatatatctcactgatggtgccagcaagggggtgatgcagatattaaatactatcatcagaggtcaagacgatgggattttggttccagtcccacaatacccggtctagtcagcaatgtattgtctgcttggtggt

SEQ ID NO: 5933 - DNA, 138 bp, Glycine max
  Clone ID: 701050803H1
atgttaatgaacttcgtcaatcagttgaacaggctcgctttaaaggaataactgttaaagcaatggtgatcataaatcctggaaaccctactggtcaatgccttagtgaagctaatctaagagaggttttgcaattct

SEQ ID NO: 5934 - DNA, 229 bp, Glycine max
  Clone ID: 700684722H1
aggctggaaaggttccagatgtttactactgcctcaagcttttggaagccactggcatatccactgttcctggttcaggatttggtcagaaagaaggggtgttccatttgaggacaactattttaccagctgaggaagacatgcctgatattatggatagtttcaaaaagttcaatgatgaattcatggagctctacgaagacgatagaggttattcaaggttgtaaga

SEQ ID NO: 5935 - DNA, 235 bp, Glycine max
  Clone ID: 700872191H1
gtttactactgcctcaagcttttggaagccactggcatatccactgttactggttcaggatttggtcagaaagaaggggtgttccatttgaggagaactattttaccagctgaggaagacatgcctgatatttggatagtttcaaaaagttcaatgatgaattcatggagcaatacgaagacgatagaggttattcaaggttgtaagaaaatcattgtaaaagctgcattatact

SEQ ID NO: 5936 - DNA, 260 bp, Glycine max
  Clone ID: 700738627H1
aaagagtcaatatgctgtcagaggtgaattataccttcgagcttctgaacttcagaaagagggcaaaaagattatctttactaatgttggcaacccgcatgcattgggacagaaaccactgagcttccctcgccaggttgttgctttgtgccaagctccattcctacttgatgatcctaatgttggactgctattccctgctgatgcaattgcaagagctaaacactatctttcattgacctcgggtggttaaggtgctt

SEQ ID NO: 5937 - DNA, 251 bp, Glycine max
  Clone ID: 700681703H1
atgaaaacgtgaagaagagtcaatatgctgtcagaggtgaattataccttcgagcttctgaacttcagaaagagggcaaaaagattatctttactaatgttggcaacccgcatgcattgggacagaaaccactgagcttccctcgccaggttgttgctttgtgccaagctccattcctacttgatgatcctaatgttggactgctattccctgctgatgcaattgcaagagctaaacactatctttcattg

SEQ ID NO: 5938 - DNA, 240 bp, Glycine max
  Clone ID: 700961778H1
tgaaaacgtgaagaagagtcaatatgctgtcagaggtgaattataccttcgagcttctgaacttcagaaagagggcaaaaagattatctttactaatgttggcaacccgcatgcattgggacagaaaccactgagcttccctcgccaggttgttgctttgtgccaagctccattcctacttgatgatcctaatgttggactgctattccctgctgatgcaattgcaagagctaaacacta

SEQ ID NO: 5939 - DNA, 278 bp, Glycine max
  Clone ID: 700666316H1
ctgcaagaagtcttctccttcaccatgccaccaaagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattgggacagaaaccactgagcttccctcgtcaggttgttgctttgtgccaagctccattcctacttgatgatcctaatgttggactgctattccctgctgatgc

SEQ ID NO: 5940 - DNA, 268 bp, Glycine max
  Clone ID: 700685706H1
catgccaccaaagcctttagactatgggtcaataaatgaaaacgtgaagaagagtcaatatgctgtcagaggtgaattataccttcgagcttctgaacttcagaaagagtgcaaaaagattatctttactaatgttggcaacccgcatgcattgggacagaaaccactgagcttccctcgccaggttgttgctttgtgccaagctccattcctacttgatgatcctaatgttggactgctattccctgctgatgcaatgcaagagcta

SEQ ID NO: 5941 - DNA, 250 bp, Glycine max
  Clone ID: 700739093H1
agattatctttactaatgttggcaacccgcatgcattgggacagaaaccactgagcttccctcgccaggttgttgctttgtgccaagctccattcctacttgatgatcctaatgttggactgctattcccgctgatgcaattgcaagagctaaacactatctttcattgacctcgggtggtttaggtgcttatagtgactcccgtggccttccaggagtgaggaaggaagttgctgatcatactcaggcg

SEQ ID NO: 5942 - DNA, 264 bp, Glycine max
  unsure (1)...(264): unsure at all n locations
  Clone ID: 700666387H1
ctgcaagangtcttctccttcaccatgccaccaaagcctntagactatgggtcaataaatgaaaacgtgaagaagagtcaatatgctgtcagaggtgaattataccttcgagcttctgagcttcagaaagagggcaaaaagattanatttactaatgttggcaacccacatgcattgggacagaaaccactgagcttccctcgtcaggttgttgctttgtgccaagcnccatncctacttgatgatccnaatgtnggactgcta

SEQ ID NO: 5943 - DNA, 253 bp, Glycine max
  unsure (1)...(253): unsure at all n locations
  Clone ID: 700993520H1
aagattatatttactantnttggcaanccacatgcattnggacanaaaccactgagcttccctcgtcaggttgttgncttntgccaagctccattcctacttgatgatcctaatgttggactgctattccctgctgatgcaattgcaagagctaaacactatctttcattgacctcgggcggtttaggcgcttatagtgactcccgcggccttccaggagtgaggaaggangtggctgagttcatactcaggc

SEQ ID NO: 5944 - DNA, 255 bp, Glycine max
  Clone ID: 700896371H1
atccaattcctcagtaacatctgcaggaagtcttctccttcaccatgccaccacagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattgggacagaaaccactgagcttccctcgtcaggttgttgctttgtgccaagctccattcc

SEQ ID NO: 5945 - DNA, 244 bp, Glycine max
  unsure (1)...(244): unsure at all n locations
  Clone ID: 700997253H1
cgtcaggntgtngctttgtgccaagctccattcctacttgatgatcctaatgttggactgctattccctgctgatgcaattgcaagagctaaacactatctttcattgacctcgggcggtttaggcgcttatagtgactcccgcggccttccaggagtgaggnaggaagtngctgagttcatactcaggcgtgatggttanccaactgatccagaactcatatatctcactgatggtgccagca

SEQ ID NO: 5946 - DNA, 248 bp, Glycine max
  unsure (1)...(248): unsure at all n locations
  Clone ID: 700995571H1
accactgagcttccctcgccaggttgttgctttgtgccaagctccattcctacttgatgatcctaatgttggactgctattccctgctgatgcaattgcaaganctaaacactatctttcattgacctcgggtggtttaggtgcttatagtgactcccgtggccttccaggagtgaggaaggaagttgctgagttcatactcaggcgtgatggttatccaactgatccagagctcatatatctcactg

SEQ ID NO: 5947 - DNA, 302 bp, Glycine max
  unsure (1)...(302): unsure at all n locations
  Clone ID: 700648011H1
gaaaccactgagcttccctcgtcaggttgttgctttgtgccaagctccattcctacttgatgatcctaatgttggactgctattccctgctgatgcaattgcaagagctaaacactatctttcattgacctcgggcggtttaggcgcttatagtgactcccgcggccttccaggagtgangaaggaagtggctgagttcatactcaggcgtgatggttatccactgatccagaactcatatatctcatgatggtgccagcaaggggtgatgcagatattaatactatcatcagaggtcagag

SEQ ID NO: 5948 - DNA, 246 bp, Glycine max
  Clone ID: 700850732H1
gatctatatgaatacagcaccaaatgacccacttgcataacatctgcaagaagtcttctccttcaccatgccaccaaagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattgggacagaaaccactgagcttccctcg

SEQ ID NO: 5949 - DNA, 276 bp, Glycine max
  unsure (1)...(276): unsure at all n locations
  Clone ID: 700557773H1
acttgactcgattgcaagtnnatccacgacacactgttcgcttcacaaaagcttcgaatccaattcctcagtaacatctgcannaagtcttctccttcaccatgccaccaaagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattgggacagaaaccactgagcttcc

SEQ ID NO: 5950 - DNA, 236 bp, Glycine max
  Clone ID: 700874138H1
cacaaaagcttcgaatccaattcctcagtaacatctgcatgaagtcttctccttcaccatgccaccaaagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattgggacagaaaccactgagcttccctc

SEQ ID NO: 5951 - DNA, 299 bp, Glycine max
  unsure (1)...(299): unsure at all n locations
  Clone ID: 700559725H1
cccataccgaacactcttcttcaatcacgcgaaggtggtctcgattgcnagtgatccacgatacactctacgcttcacaaaaccttcaaacccaattccacagaattcttctgcntcaccatgccaccaaagcctttagactatgggtcaataaatgaaaacgtgaagaagagtcaatatgctgtcagaggtgaattataccttcgagcttctgaacttcagaaagagggcaaaaagattatctttactaatgttggcaacccgcatgcattgggacagaaaccactggcttccctcgc

SEQ ID NO: 5952 - DNA, 284 bp, Glycine max
  unsure (1)...(284): unsure at all n locations
  Clone ID: 701105639H1
ctcgagccgtctcacttgactcgattgcaagtgatccacgacacactgttcgcttcacaaactgttngaatgcaattcctcagtaacattcgcacgaagtcttactcttcaccatgccaccaaagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattgggacagaaaccactgagc

SEQ ID NO: 5953 - DNA, 270 bp, Glycine max
  unsure (1)...(270): unsure at all n locations
  Clone ID: 700994494H1
cgaaggtngtctcacttgactcgattgcaagtgatccacgacacactgttcgcttcacaaaagcttcgaatccaattcctcagtaacatctgcaagangtcttctcctaccaccatgccaccaaagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattggga

SEQ ID NO: 5954 - DNA, 139 bp, Glycine max
  Clone ID: 700738237H1
agattatctttactaatgttggcaacccgcatgcattgggacagaaaccactgagcttccctcgccaggttgttgctttgtgccaagctccattcctacttgatgatcctaatgttggactgctattccctgctgatgc

SEQ ID NO: 5955 - DNA, 281 bp, Glycine max
  unsure (1)...(281): unsure at all n locations
  Clone ID: 700555071H1
ttcttcaatcaagcgaaggtngtctcacttgactcgattgcaagngatccacgacacactgttcgcttcacaaagcttcgaatccaattcctcagtaacatctgcangaagtcttctccttcaccatgccaccnaagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattggga

SEQ ID NO: 5956 - DNA, 257 bp, Glycine max
  Clone ID: 700786177H2
gaacactcttcttcaatcaagcgaaggtggtctcgattgcaagtgatccacgatacactctacgcttcacaaaaccttcaaacccaattccacagaattcttctgatacaccatgccaccaaagcctttagactatgggtcaataaatgaaaacgtgaagaagagtcaatatgctgtcagaggtgaattataccttcgagcttctgaacttcagaaagagggcaaaaagattatctttactaatgttggcaacccgc

SEQ ID NO: 5957 - DNA, 285 bp, Glycine max
  unsure (1)...(285): unsure at all n locations
  Clone ID: 700554414H1
gtctcacttgactcgattgcaagtgatccacgaccacactgttcgcttcacaaaagcttcgaatccattcctcagtaacatctgccnnncngtcttctccttcaccatgccacctaagcctttagactatgggtcaataaatgaaaacgtgagaagagtcaatatgctgtcagaggtgaattataccttcgagcttctgagcttcagaaagagggcaaaaagattatatttactaatgttggcaacccacatgcattgggacagaaaccatgagcttccctcgtc

SEQ ID NO: 5958 - DNA, 261 bp, Glycine max
  Clone ID: 700741128H1
gtctcacttgactcgattgcaagtgatccacgacacactgttcgcttcacaaaagcttcgaatccaattcctcagtaacatctgcaagaagtcttctccttcaccatgccaccaaagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattggga

SEQ ID NO: 5959 - DNA, 261 bp, Glycine max
  Clone ID: 700965158H1
cactcttcttcaatcaagcgaaggtggtctcgattgcaagtgatccacgatacactctacgcttcacaaaaccttcaaacccaattccacagaattcttctgcttcaccatgccaccaaagcctttagactatgggtcaataaatgaaaacgtgaagaagagtcaatatgctgtcagaggtgaattataccttcgagcttctgaacttcagaaagagggcaaaaagattatctttactaatgttggcaacccgcatgcatt

SEQ ID NO: 5960 - DNA, 272 bp, Glycine max
  Clone ID: 700685250H1
cggctcgagtggtctcacttgactcgattgcaagtgatccacgacacactgttcgcttcacaaaagcttcgaatccaattcctcagtaacatctgcaagaactcttctcagtcaccatgccaccaaagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattggga

SEQ ID NO: 5961 - DNA, 252 bp, Glycine max
  unsure (1)...(252): unsure at all n locations
  Clone ID: 700991457H1
cttgactcgattgcaagtnatccacgacacactgttcgcttcacaaaagcttcgaatccaattcctcagtaacatctgcangaagtcttctccttcaccatgccaccaaagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattg

SEQ ID NO: 5962 - DNA, 259 bp, Glycine max
  Clone ID: 700684192H1
ggtctcacttgactcgattgcaagtgatccacgacacactgttcgcttcacaaaagcttcgaatccaattcctcagtaacatctgcatgaagtcttctccttcaccatgccaccaaagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattg

SEQ ID NO: 5963 - DNA, 258 bp, Glycine max
  Clone ID: 700871122H1
gtctcacttgactcgattgcaagtgatccacgacacactgttcgcttcacaaaagcttcgaatccaattcctcagtaacatctgcttgaagtcttctccttcaccatgccaccaaagcctttagactatgggtcaataaatgaaaacgtgaagaagagtcaatatgctgtcagaggtgaattataccttcgagcttctgagcttcagaaagagggcaaaaagattatatttactaatgttggcaacccacatgcattg

SEQ ID NO: 5964 - DNA, 274 bp, Glycine max
  unsure (1)...(274): unsure at all n locations
  Clone ID: 700997304H1
aatcaagcgaaggtggtctcgattgcaagtnatccacgatacactctacgcttcacaaaaccttcaaacccaattccacagaattcttctgnncncaccatgccaccaaagcctttagactatgggtcaataaatgaaaacgtgaagaagagtcaatatgctgtcagaggtgaattataccttcgagcttctgaacttcagaaagagggcaaaaagnttatctttactaatgttggcaacccgcatgcnattgggacagnanccattgggttcc

SEQ ID NO: 5965 - DNA, 269 bp, Glycine max
  Clone ID: 700685731H1
ccataccgaacactcttcttcaatcaagcgaaggtggtctcgattgcaagtgctccacgatacactctacgcttcacaaaaccttcaaacccaattccacagaattcttctgcttcaccatgccaccaaagcctttagactatgggtcaataaatgaaaacgtgaagaagagtcaatatgctgtcagaggtgaattataccttcgagcttctgaacttcagaaagagggcaaaaagattatctttactaatgttggcaacccgcatgca

SEQ ID NO: 5966 - DNA, 267 bp, Glycine max
  Clone ID: 700685724H1
ccataccgaacactcttcttcaatcaagcgaaggtggtctcgattgcaagtgctccacgatacactctacgcttcacaaaaccttcaaacccaattccacagaattcttctgatacaccatgccaccaaagcctttagactatgggtcaataaatgaaaacgtgaagaagagtcaatatgctgtcagaggtgaattataccttcgagcttctgaacttcagaaagagggcaaaaagattatctttactaatgttggcaacccgcatg

SEQ ID NO: 5967 - DNA, 250 bp, Glycine max
  Clone ID: 700739069H1
tctcgattgcaagtgatccacgatacactctacgcttcacaaaaccttcaaacccaattccacagaattcttctgcatacaccatgccaccaaagcctttagactatgggtcaataaatgaaaacgtgaagagagtcaatatgctgtcagaggtgaattataccttcgagcttctgaacttcagaaagagggcaaaaagattatctttactaatgttggcaacccgcatgcattgggacaaaccactgag

SEQ ID NO: 5968 - DNA, 249 bp, Glycine max
  Clone ID: 700741337H1
ctcacttgactcgattgcaagtgatccacgacacactgttcgcttcacaaaagcttcgaatccaattcctcagtaacatctgcaagaggtcttctccttcaccatgccaccaaagcctttagactatgggtcaataaatgaaaacgtgaagaagagtcaatatgctgtcagaggtgaattataccttcgagcttctgagcttcagacagagggcaaaaagattatatttactaatgttggcaacccaca

SEQ ID NO: 5969 - DNA, 260 bp, Glycine max
  Clone ID: 700683155H1
cccataccgaacactcttcttcaatcaagcgaaggtgttctcgattgcaagtgctccacgatacactctacgcttcacaaaaccttcaaacccaattccacagaattcttctgattcaccatgccaccaaagcctttagactatgggtcaataaatgaaaacgtgaagaagagtcaatatgctgtcagaggtgaattataccttcgagcttctgaacttcagaaagagggcaaaaagattatctttactaatgttggcaa

SEQ ID NO: 5970 - DNA, 247 bp, Glycine max
  unsure (1)...(247): unsure at all n locations
  Clone ID: 700994202H1
tctcacttgactcgattgcaagtgatccacgacacactgttcgcttcacaaaagcttcgaatccaattcctcagtaacatctgcnananntcttctccttcaccatgccaccaaagctttagactatgggtcaataaatgaaaacgtgaagaagagtcaatatgctgtcagaggtgaattataccttcgagcttctgagcttcagaaagagggcaaaaagattatatttactaatgttggcaaccca

SEQ ID NO: 5971 - DNA, 272 bp, Glycine max
  unsure (1)...(272): unsure at all n locations
  Clone ID: 700555575H1
ttcttcaatcaagcgaaggtngtctcacttgactcgattgcaagtgatccacgacacactgttcgcttcacaagcttcgaatccaattcctcagtaacatctgcanaagtcttctccttcaccatgccacncnaagcctttagactatgggtcaataaatgaaaacgtgaagaagagtcaatatgctgtcagaggtgaattataccttcgagcttctgagcttcagaaagagggcaaaaagattatattgactaatgttggcaacccacatg

SEQ ID NO: 5972 - DNA, 265 bp, Glycine max
  unsure (1)...(265): unsure at all n locations
  Clone ID: 701000739H1
ttggactgctattccctgctgatgcaattgcaagagctaaacactatctttcattgacctcgggcggtttaggcgcttatagtgactcccgcggccttccaggagtgaggaaggaagtggctgngttcatactcaggcgtgatggttatccaactgatccagaactccatatatcctccactgatggtgccnagcaaagggggtgatgcnagatattaaatactatccatcagaggtccaagacgatgggattttggttccagtc

SEQ ID NO: 5973 - DNA, 260 bp, Glycine max
  unsure (1)...(260): unsure at all n locations
  Clone ID: 700740011H1
ctcgattgcaagtgatccacgatacactctacgcttcacaaaaccttcaaacccaattccacagaatacatcacaaaaancatgccaccaaagcccttagactatgggtcaataaatgaaaacgtgaagaagagtcaatatgctgtcagaggtgaattataccttcgagcttctgaacttcagaaagaggcgcaaaagattatctttactaatgttggcaacccgcatgcattgggacagaaaccactgagcttccctcg

SEQ ID NO: 5974 - DNA, 252 bp, Glycine max
  unsure (1)...(252): unsure at all n locations
  Clone ID: 700994043H1
cactcttcttcaatcaagcgaaggtggtctcgattgcaagtnatccacgatacactctacgcttcacaaaaccttcaaacccaattccacagaattcttctgcacncaccatgccaccaaagcctttagactatgggtcaataaatgaaaacgtgaagaagagtcaatatgctgtcagaggtgaattataccttcgagcttctgaacttcagaaagagggcaaaaagattatctttactaatgttggcaacc

SEQ ID NO: 5975 - DNA, 276 bp, Glycine max
  Clone ID: 700555709H1
accgaacactcttcttcaatcaagcgaaggtggtctcgattgcaagtgatccacgatacactctacgcttcacaaaaccttcaaacccaattccacagaattcttctgcgctcaccatgccaccaaagcctttagactatgggtcaataaatgaaaacgtgaagaagagtcaatatgctgtcagaggtgaattataccttcgagctttctgaacttcagaaagagggcaaaaagattatctttactaatgttgggcaacccgcatgcattgggaca

SEQ ID NO: 5976 - DNA, 249 bp, Glycine max
  Clone ID: 701107588H1
atgccaccaaagcctttagactatgggtcaataaatgaaaacgtgaagaagagtcaatatgctgtcagacgtgaattataccttcgagcttctgagcttcagaaagagggcacgaagattatatttactaatgttgggaacccacatgcattgggacagaaaccactgagcttccctcgtcaggttgttgccttgtgccaagctccagtcctacttgatgatcctaatgttggactgctattccctgct

SEQ ID NO: 5977 - DNA, 251 bp, Glycine max
  Clone ID: 700871057H1
gcgaaggtggtctcacttgactcgattgcaagtgatccacgacacactgttcgcttcacaaaagcttcgaatccaattcctcagtaacatctgcatcaagtcttcaccttcaccatgccaccaaagcctttagactatgggtcaataaatgataacgtgaagaagagtcaatatgctgtcagaggtgaattataccttcgagcttctgagcttcagaaagagggcaaaaagattatatttactaatgttgg

SEQ ID NO: 5978 - DNA, 248 bp, Glycine max
  Clone ID: 700744973H1
gcgaaggtggtctcacttgactcgattgcaagtgatccacgacacactgttcgcttcacaaaagcttcgaatccaattcctcagtaacatctgcatgaagtcttcacgcttcaccatgccaccaaagcctttagactatgggtcaataaatgaaaacgtgaagaagagtcaatatgctgtcagaggtgaattataccttcgagcttctgagcttcagaaagagggcaaaaagattatatttactaatg

SEQ ID NO: 5979 - DNA, 235 bp, Glycine max
  Clone ID: 700741744H1
ctcacttgactcgattgcaagtgatccacgacacactgttcgcttcacaaaagcttcgaatccaattcctcagtaacatctgcatcaagtcttctccttcaccatgccaccaaagcctttagactatgggtcaataaatgaaaacgtgaagaagagtcaatatgctgtcagaggtgaattataccttcgagcttctgagcttcagaaagagggcaaaaagattatatttactaat

SEQ ID NO: 5980 - DNA, 168 bp, Glycine max
  Clone ID: 700792044H1
ccctcgtcaggttgttgctttgtgccaagctccattcctacttgatgatcctaatgttggactgctattccctgctgatgcaattgcaagagctaaacactatctttcattgacctcgggcggtttaggcgcttatagtgactcccgcggccttccaggagtgaggaa

SEQ ID NO: 5981 - DNA, 261 bp, Glycine max
  unsure (1)...(261): unsure at all n locations
  Clone ID: 700993716H1
ccgaacactcttcttcaatcaagcgaaggtggtctcgattgcaagtgatccacgatacactctacgcttcacaaaaccttcaaacnccaattccacagaatncatnagccnnaccatgccaccaaagcctttagactatgggtcaataaatgaaaacgtgaagaagagtcaatatgctgtcagaggtgaattataccttcgagntttctgaacttcagaaagagggtaaaaagattatctttactaatgttggcaacccgt

SEQ ID NO: 5982 - DNA, 258 bp, Glycine max
  unsure (1)...(258): unsure at all n locations
  Clone ID: 700684326H1
ggtggtctcacttgactcgattgcgagtgatccacgacacactgttcggttcacaaaagcttcgaatgcgattcctcagtaacatctagatgaganagttctccttcaccatgccaccagancgtttatagtatnngtcaataaatgataacgtgaagaagagtcaatatgctgtcagaggtgaattataccttcgagcttctgagcttcagagagagggcagaaagattatgattactaatgttggcgaaccacatg

SEQ ID NO: 5983 - DNA, 277 bp, Glycine max
  unsure (1)...(277): unsure at all n locations
  Clone ID: 700989256H1
gtctcacttgactcgattgcaatgatccacgacacactgttcgcttcacaaaagcttcgaatccaattcctcagtaacatctgcgcnnaaccttctccttcaccatgccaccaaagcctttagactatgggnccaataaatgaaaacgtgaagaagagtcaatatgctgtcagaggtgaattataccttcgagcttctgagcttcagaaagagggcaaaaagattatattancaangtgggnaacccaanngnatggggaaanaacccatggnnctc

SEQ ID NO: 5984 - DNA, 234 bp, Glycine max
  Clone ID: 700791590H1
ctcttcttcaatcaagcgaaggtggtctcgattgcaagtgcattacgatacactctacgcttcacaaaaccttcaaacccaattccacagaattcttctgcatcaccatgccaccaaagcctttagactatgggtcaataaatgaaaacgtgaagaagagtcaatatgctgtcagaggtgaattataccttcgagcttctgaacttcagaaagagggcaaaaagattatcttta

SEQ ID NO: 5985 - DNA, 240 bp, Glycine max
  Clone ID: 700872519H1
gtctcacttgactcgattgcaagtgatccacgacacactgttcgcttcacaaaagcttcgaatccaattcctcagtaacatctatacaaagtcttctcttcaccatcccaccaaagcctttagactatgggtcaataaatgaaaacgtgaagaagagtcaatatgctgtcagaggtgagctcataccttcgagcttctgagcttcagaaagagggcaaaaagattatatttactaatgtt

SEQ ID NO: 5986 - DNA, 289 bp, Glycine max
  Clone ID: 700645949H1
cccataccgaacactcttcttcaatcaagcgaaggtggtctcgattgcaagtgctccacgatacactctacgcttcacaaaaccttcaaacccaattccacagaattcttctgcatcaccatgccaccaaagcctttagactatgggtcaataaatgaaaacgtgaagaagagtcaatatgctgtcagaggtgaattataccttcgagcttctgaacttcagaaagagggcaaaaagattatctttactaatgttggcaacccgcatgcatagggacagaaaccactga

SEQ ID NO: 5987 - DNA, 239 bp, Glycine max
  unsure (1)...(239): unsure at all n locations
  Clone ID: 700996252H1
cccgaacactcttcttcaatcaagcgaaggtggtctcgattgcnagtnatccacgatacactctacgcttcacaaaaccttcaaacccaattccacagaattcttctgcntcaccatgccaccaaagcctttagactatgggtcaataaatgaaaacgtgaanaagagtcaatatgctgtcagaggtgaattataccttcgagcttctgaacttcagaaagagggcaaaaagattatct

SEQ ID NO: 5988 - DNA, 247 bp, Glycine max
  Clone ID: 700876656H1
gcgaaggtggtctcacttgactcgattgcaagtgatccacgacacactgttcgcttcacaaaagcttcgaatccaattcctcagtaacatctgcataaagtcttctccttcaccatgccaccaaagcctttagactatgggtcaataaatgacaacgtgaagaagagtcaatatgctgtcagaggtgaattataccttcgagcttctgagcttcagaaagagggcaaaaagattatatttactaatg

SEQ ID NO: 5989 - DNA, 242 bp, Glycine max
  Clone ID: 700874318H1
cccataccgaacactcttcttcaatcaagcgaaggtggtctcgattgcaagtgatccacgatacactctacgcttcacaaaaccttcaaacccaattccacagaattcttaagatacaccatgccaccaaagcctttagactatgggtcaataaatgaaaacgtgaagaagagtcaatatgctgtcagaggtgaattataccttcgagcttctgaacttcagaaagagggcaaaaagattat

SEQ ID NO: 5990 - DNA, 264 bp, Glycine max
  Clone ID: 700737927H1
gtctcacttgactcgattgcaagtgatccacgacacactgttcgcttcacaaaagcttcgaatccaattcctcagtaacatctgacagaagtcttctccttcttcatgccaccaaagcctttagactatgggtcaataaatgaaaacgtgaagaagagtcaatatgctgtcagaggtgaattataccttcgagcttctgagcttcagaaagagggcaaaaagatgatattgactaatgttggcaacccacatgcattgggacag

SEQ ID NO: 5991 - DNA, 252 bp, Glycine max
  Clone ID: 700740448H1
tctacaaggttgcatcaatatcacttagtccaaatgttccagcacaaatatttatgggagttatgctccatccacctcaacctggagatatttcttatgacaaatttgttagggagagcaccggaatacttgaatcactgagaagaagagcaaggctaatgactgatggattcaacagttgcagaaatgtggtttgtaattttactgaaggtgccatgtattcattccctcaaatacgtttgccgccaagag

SEQ ID NO: 5992 - DNA, 253 bp, Glycine max
  Clone ID: 700954623H1
atgaacgacccttcattagttctagaaaggttttgatggacttggggccacctataagcaaggaagtccagcttatttcttttcactccgtgtcaaaaggttattatggtgaatgtggacagcgaggtggatattttgaaatgaccaacattcctccagagacagttgatgagatctacaaggttgcatcaatatcacttagtccaaatgttccagcacaaatatttatgggagttatgctccatccacctca

SEQ ID NO: 5993 - DNA, 258 bp, Glycine max
  Clone ID: 701142577H1
cgttgcatcaatatcacttagtccaaatgttccagcacaaatatttatgggagttatgctccatccacctcaacctggagatatttcttatgacaaatttgttagggagagcaccggaatacttgaatactgagaagaagagcaaggctaatgactgatggattcaacagttgcagacatgtggtgtgtaattttactgaaggtgccatgtattcattccctcaaatacgtttgccgccaagagctttagaggctgct

SEQ ID NO: 5994 - DNA, 264 bp, Glycine max
  Clone ID: 701000510H1
atgaagggtcgttcatcctgatatatattcgtctggtaaacctcatctccaagcaaggctaaattttcttttcactctgtgtcaaaaggttattatggtgaatgtggacagcgaggtggatattttgaaatgaccaacattcctccagagacagttgatgagatctacaaggttgcatcaatatcacttagtccaaatgttccagcacaaatatttatgggagttatgctcaatccacctcaacctggagatatttcttatgac

SEQ ID NO: 5995 - DNA, 252 bp, Glycine max
  Clone ID: 700874683H1
caaatatttatgggagttatgctccatccacctcaacctggagatatttcttatgacaaatttgttagggagagcaccggaatacttgaatcactgagaagaagagcaaggctaatgactgatggatcaacagttgcagaaatgtggtttgtaattttactgaaggtgccatgtattcatcccctcaaatacgtttgccgccaagagctttgaggctgcctaacaaggctgcaaaggttccagatgttttct

SEQ ID NO: 5996 - DNA, 246 bp, Glycine max
  Clone ID: 700874576H1
caaatatttatgggagttatgctccatccacctcaacctggagatatttcttatgacaaatttgttagggagagcaccggaatacttgaatcactgagaagaagagcaaggctaatgactgatggatcaacagttgcagaaatgtggtttgtaattttactgaaggtgccatgtattcattccctcaaatacgtttgccgccaagagctttagaggctgctaaacaggctgcaaaggttccagatg

SEQ ID NO: 5997 - DNA, 166 bp, Glycine max
  Clone ID: 700999910H1
gaaatgaccaacattcctccagagacagttgatgagatctacaaggttgcatctctatcacttagtccaaatgttccagcacaaatatttatgggagttatgctcaatccacctcaacctggagatatttcttatgacaaatttgttagggagagcaccggaatac

SEQ ID NO: 5998 - DNA, 156 bp, Glycine max
  unsure (1)...(156): unsure at all n locations
  Clone ID: 701001711H1
ttcttatgacaaatttgttaggggagagcaccggaatacttgacatcactgagtcgaagagcaaggctaatgactgatggattcaacagttgcagaaatgtggtttgtaattttactgaaggtgccatgtnttccttcccctcaaatacgtttgcc

SEQ ID NO: 5999 - DNA, 292 bp, Glycine max
  Clone ID: LIB3030-005-Q1-B1-F1
caccttttcaaccgttcactccttcttctgcgtcaccgtcaccatcataatcaccatccctttccttattcttcttctgtttcatccctctccccattttctcgctctcgtttcttgtcctctactcctttctccatggcttctgattcccctttccctgtcaccgctcaaaacatcaaccccaaggttctgaaatgtgagtatgctgttagaggagaggttgtcacacttgcccagaatttgcaaaaggatttacaggccaatccaggttctcacccatttgatgagatac

SEQ ID NO: 6000 - DNA, 370 bp, Glycine max
  Clone ID: LIB3051-078-Q1-K1-B5
atcaaatctctctttatatataaccctcacaatgcggaaatatgctgcagacagattcaggcaccttttcaaccgttcactccttcttctgcgtcaccgtcaccatcataatcaccatccctttccttattcttcttctgtttcatccctctccccattttctcgctctcgtttcttgtcctctactcctttctccatggcttctgattcccctttccctgtcaccgctcaaaacatcaaccccaaggttctgaaatgtgagtatgctgttagaggagaggttgtcacacttgcccagaatttgcaaaaggatttacaggccaatccaggttctcacccatttgatgagatactttactgcaacattgga

SEQ ID NO: 6001 - DNA, 418 bp, Glycine max
  Clone ID: LIB3051-006-Q1-K1-D5
cccacgcgtccgcccacgcgtccgggcaccttttcaaccgttcactccttcttctgcgtcaccgtcaccatcataatcaccatccctttccttattcttcttctgtttcatccctctccccattttctcgctctcgtttcttgtcctctactcctttctccatggcttctgattcccctttccctgtcaccgctcaaaacatcaaccccaaggttctgaaatgtgagtatgctgttagaggagaggttgtcacacttgcccagaatttgcaaaaggatttacaggccaatccaggttctcacccatttgatgagatactttactgcaacattggaaatcctcagtctctgggccagcagccaataacttttttccgagaggttcttgcattatgtgaccatccagctatattggacaa

SEQ ID NO: 6002 - DNA, 381 bp, Glycine max
  Clone ID: LIB3051-006-Q1-E1-D5
cccacgcgtccgcccacgcgtccgggcaccttttcaaccgttcactccttcttctgcgtcaccgtcaccatcataatcaccatccctttccttattcttcttctgtttcatccctctccccattttctcgctctcgtttcttgtcctctactcctttctccatggcttctgattcccctttccctgtcaccgctcaaaacatcaaccccaaggttctgaaatgtgagtatgctgttagaggagaggttgtcacacttgcccagaatttgcaaaaggatttacaggccaatccagcttctcacccatttgatgagatactttactgcaacattggaaatcctcagtctctgggcccagcagccaataactttttttccgaga

SEQ ID NO: 6003 - DNA, 287 bp, Glycine max
  Clone ID: LIB3051-113-Q1-K1-B4
caggcaccttttcaaccggtcactcattcttctgggccaccggcaccatcaccaggccttggcttcttcttcttctctctccccattttctcgctctcggttcttctcctctacgccgttctccatggcttctgattccccttttcctgtcaccggtcaaaacatcaaccccaagggtcttaaaatgtgagtatgctgttagaggagagggtgtcacacttgcccagaatttgcaaaaggatttacaggccaatccaggctctcacccatttgatgagatactttac

SEQ ID NO: 6004 - DNA, 400 bp, Glycine max
  Clone ID: LIB3028-005-Q1-B1-A11
ctcttttgtcagacacgtataagtgtatgacattctctactacaactacttggtgtttcccataccgaacactcttcttcaatcaagcgaaggtggtctcgattgcaagtgatccacgatacactctacgcttcacaaaaccttcaaacccaattccacagaattcttctgcttcaccatgccaccaaagcctttagactatgggtcaataaatgaaaacgtgaaaaaaagtcaatatgctgtcagaggtgaattataccttcgagcttctgaaacttcagaaagagggcaaaaggattatctttactaatgttggcaacccgcatgcattgggacagaaaccaatgagcttccctccccaagttgttgctttgtgccaagctccattcctacttgatga

SEQ ID NO: 6005 - DNA, 122 bp, Zea mays
  Clone ID: 700041501H1
cgcccctctccacactgccaactcgctccgaagagggaggaggacgacgccggttgccactgccactgccgcgccgcgccgctcccgtctcccctccctccgcgggaactcgacgccaccat

SEQ ID NO: 6006 - DNA, 301 bp, Zea mays
  Clone ID: 700051224H1
ccataatgcttttgatcttcttgcaagatatggcaccactcaccttgtattcaatgatgatattcagggaacagcttctgtggttcttgctgggcttattacagcacaaacattacttggtggttcattggcagatcacacttaccttttccttggtgctggagaggttattttctctgtgattcttttataggcatttattttcaaggtagtctttatatgctgatttctacggtattgttatctaataaaataccggacgtaatgtgctgatctacccctctttatttcaagcgtgtca

SEQ ID NO: 6007 - DNA, 299 bp, Zea mays
  Clone ID: 700073375H1
cggacgcgtgggtcggcctccgccagagggtgccaccggcgaggagtaccatgaacttcttgaagagttcatgaccgccgtcaagcaaaactacggcgagacggtcctcacccagttcgaagacttcgccaaccacaacgcctttgacctgctcgagaagtacagggagagccatctcgtcttcaacgacgatatccagggaacagcatccgtggtcctcgctggcctcctggcggcgctcaaggtggtcggcgggacactggcggaccacacttacctgttcctcggcgccggcgagg

SEQ ID NO: 6008 - DNA, 260 bp, Zea mays
  Clone ID: 700101813H1
ggaaacggcgagaggcttttcctgaaggttcatcatagctatataccgctgcaaaggggtctggtactgccgcaggtgttcatgaacttcttaatttggagttcctgagatagtactgccggaggaagcagtccacgcaagtagtgtccatccctttcctcctctgtgaaagcaagacccttgttgtggtgtggatccctcaaaagggtgtaaccgcttgcgacggaggtggcccagggcatgacgggcagctcctcgct

SEQ ID NO: 6009 - DNA, 251 bp, Zea mays
  Clone ID: 700104958H1
ggggaggttagttaaaacatgtcctggtgaactgttatttcctttgtcaccaactttcgaagcctactataactagtatcttatgaattgagattgtgaccattagtaagaatcctttttggttgaggaaagtagacccatagataagattctgataatgtatttgatttcaggctggaactggtattgcagaactcattgctcttgagatttcaaaacagacgtcggctccaattgaagagtgccgcaag

SEQ ID NO: 6010 - DNA, 273 bp, Zea mays
  Clone ID: 700219021H1
gatctctgcccacattgcagccagcgttgcagcaaaggcatatgaacttggtttggcaagtaggcgccctcggccaaaggacctggtgaaatatgcagagagctgcatgtacagccccatctaccgcaactaccgttgaattcggatcaactccagttatgtgcaaatcagcagcagccttgcgtcaactgcaagatttcctaagaatataactcgtttcagtctttcatactgtaataccctaagccctctagcaatagctgtttcacgtcc

SEQ ID NO: 6011 - DNA, 279 bp, Zea mays
  Clone ID: 700346164H1
cttgtccttcaaactgatataaagacactgagggcgactcaatatggatccatacttttggcaggcctcaccaacggctcctcaatgttgtcaatgagcagcttgtagaaaagcctctcgttcccttcctatgataagatggtaccagagaaaagtatagcccaaatgaactccttatatcagctatactaatatactatgcataacaatgaaacttaatgatcagttacctcgagatccacgagggccatgtagcgctgcaaaggaaacttgtattat

SEQ ID NO: 6012 - DNA, 243 bp, Zea mays
  Clone ID: 700453338H1
ggtaaactttccctttacactgccctgggaggagttcgtccatctgcttgcttgccgatcacattggatgttggtacaaataacgaggagctgcttaatgacgaattttacattggcttgagacaaagaagagccactggccagtagtacactgattttctgcaagaatttatgagtgctgtgaaacaaaactatggggagacagtgcttattcagtttgaggattttgccaaccataacgct

SEQ ID NO: 6013 - DNA, 103 bp, Zea mays
  Clone ID: 700460886H1
attcaagttatctgtgttactgatggtgagcgaatctttggacttggagagtttggttgtcacggaatgggaattcctgtaggcaaacttgctctatacactg

SEQ ID NO: 6014 - DNA, 205 bp, Zea mays
  unsure (1)...(205): unsure at all n locations
  Clone ID: 700573176H1
cagcttgttatctctggagcaatccgtgtccacgaggatattggtcttgccgnctcggaagcactagctgctcatggtatacaggagaacttcgacaagcgatcaatctgcgcggatctcaccagcatgagaaagatctctgcgcgcatttcagcagccgtgcctgagagagcttatgaactcggtttggagacccgtctgcctc

SEQ ID NO: 6015 - DNA, 237 bp, Zea mays
  Clone ID: 701182650H1
ttcatccttcagtaggtcttcattatttgttcccacatcaatggtaataggtaagcaagcggatggccgtacacctccaagagcagtatacagtgcaagcttccccacaggaattcccatgccctggcaaccaagatctcccaggcctaaaatgcgctcaccatcagtgaccataataacctgaatactcttctctgtccagttcctcagtacctccaagatccttcccttctcctt

SEQ ID NO: 6016 - DNA, 286 bp, Zea mays
  Clone ID: 700349609H1
tgatgatattcagggaacagcttctgtggttcttgctgggcttattgcagcacaaacattacttggtggttcattggcagatcacacttaccttttccttggtgctggagaggctgggacaggtatagctgaacttatagctcttgagatctcacgtcagacgaaagctcctatagaggagtgccgcaagaaaatctggcttgttgattcaaagggcttgattgtcagtacacgaaaggagtcccttcaacacttcaagaaaccatgggctcatgagcataaacca

SEQ ID NO: 6017 - DNA, 321 bp, Zea mays
  unsure (1)...(321): unsure at all n locations
  Clone ID: 700050528H1
ganagtgcttattcagtttgaggattttgccaaccataatgcttttgatcttcttgcaagatatggcaccactcaccttgtattcaatgatgatattcagggaacagcttctgtggttcttgctgggcttattgcagcacaaacattacttggtggttcattggcagatcacacttaccttttccttggtgctggagaggctgggacaggtatcgctgaacttatagctcttgagatctcacgtcagacgaaagctcctatagaggagtgccgcaagaaaatctggcttgttgattcaaaggtcaattttatgaagagggc

SEQ ID NO: 6018 - DNA, 288 bp, Zea mays
  Clone ID: 700242979H1
cccacgcgtccgctcaggagtacactgattttctgcaagaatttatgactgctgtgaaacaaaactatggggagaaagttcttattcagtttgaggattttgccaaccataatgcttttgatcttcttgcaagatatggcaccactcaccttgtattcaatgatgatattcagggaacagcttctgtggttcttgctgggcttattgcagcacaaacattacttggtggttcattggcagatcacacttaccttttccttggtgctggagaggctgggacaggtatag

SEQ ID NO: 6019 - DNA, 272 bp, Zea mays
  Clone ID: 700577075H1
tatggggagaaagtgcttattcagtttgaggattttgccaaccataatgcttttgatcttcttgcaagatatggcaccactcaccttgtattcaatgatgatattcagggaacagcttctgtggttcttgctgggcttattgcagcacaaacattacttggtggttcattggcagatcacacttaccttttccttggtgctggagaggctgggacaggtatcgctgaacttatagctcttgagatctcacgtcagacgaaagctcctataga

SEQ ID NO: 6020 - DNA, 288 bp, Zea mays
  Clone ID: 700381724H1
ccataatgcttttgatcttcttgcaagatatggcaccactcaccttgtattcaatgatgatattcagggaacagcttctgtggttcttgctgggcttattgcagcacaaacattacttggtggttcattggcagatcacacttaccttttccttggtgctggagaggctgggacaggtatcgctgaacttatagctcttgagatctcacgtcagacgaaagctcccatagaggagtgccgcaagaaaatctggcttgttgattccaaaggcttgaatgtcagtacacg

SEQ ID NO: 6021 - DNA, 299 bp, Zea mays
  Clone ID: 700050667H1
gttaactacattcgcagcggcacgcgagggaggaccagcggcagcgtcgacctggtggtggtgcgcttcgggttcggcgaagggcgacatggagagcacgctcaaggggatacgcggcagcgatgcgccgtgcgttctggacctggacgacgcggccaccgtggcgggcggcgtcgaggacacctacggcgaggatcgcgccaccgaggagcagctcgtcacgccctggaccgtctccgtcgccagcggttacaatctgcttagggatccccgttacaacaagggacttgcgttcacag

SEQ ID NO: 6022 - DNA, 274 bp, Zea mays
  Clone ID: 700076676H1
atcacttctgttaactacattcgcacggcacaagaaggaggaccagcggcacgatcgacctggtggtggtgcgcttcgggttcggcgaagggcgacatggagagcacgctcaaggggatacgcggcacgatgcgccgtgcgttctggacctggacgacgcggccaccgtggcgggcggcgtcgaggacacctacggcgaggatcgcgccaccgaggagcagctcgtcacgccctggaccgtctccgtcgccagcggttacaatctgcttaggga

SEQ ID NO: 6023 - DNA, 224 bp, Zea mays
  Clone ID: 700155440H1
cattcgcagcggcacgggagggaggaccagcggcacgtcgacctggtggtggtgcgcttcgggttcggcgaagggcgacatcgagagcacgctcaaggggatacgcggcacgatgcgccgtgcgttctggacctggacgacgcggccaccgtggcgggcggcgtcgaggacacctacggcgaggatcgcgccaccgaggagcagctcgtcacgccctggaccgt

SEQ ID NO: 6024 - DNA, 314 bp, Zea mays
  Clone ID: 700071978H1
catgagcataaaccactcagcaacctcttagatgctgttaatgctatcaaaccaacagtgttgattggcacatccgggaaggggcaaactttcacaaaagacgttgttgaagcaatctcctcatttaacgagagaccaatcattcttgccctatcgaacccaacatcacaatctgaatgcacagctgagcaagcttacacatggagcaagggacaagcagtgtttgcgactgggagtccatttgatcctgtggagtacaatggcaagatacatgttcccggacaggcaaacaatgcctatatcttcccagggtt

SEQ ID NO: 6025 - DNA, 355 bp, Zea mays
  Clone ID: 700202802H1
tgctgttaatgctatcaaaccaacagtgttgattggcacatccgggaaggggcaaactttcacaaaagacgttgttgaagcaatctcctcatttaacgagagaccaatcattcttgccctatcgaacccaacatcacaatctgaatgcacagctgagcaagcttacacatggagcaagggacaagcagtgtttgcgactgggagtccatttgatcctgtggagtacaatggcaagatacatgttcccggacaggcaaacaatgcctatatcttcccagggtttggcctcggcgtggtgatgtctggagctatccgcgttcatgacgacatgcttctggcagcatcgggagctctg

SEQ ID NO: 6026 - DNA, 309 bp, Zea mays
  Clone ID: 700104846H1
ctcatgagcataaaccactcagcaacctcttagatgctgttaatgctatcaaaccaacagtgttgattggcacatccgggaaggggcaaactttcacaaaagacgttgttgaagcaatctcctcatttaacgagagaccaatcattcttgccctatcgaacccaacatcacaatctgaatgcacagctgagcaagcttacacatggagcaagggacaagcagtgtttgcgactgggagtccatttgactctgtggagtacaatggcaagatacatgttcccggacaggcaaacaatgcctatatcttcc

SEQ ID NO: 6027 - DNA, 283 bp, Zea mays
  Clone ID: 700444338H1
aagcaatctcctcatttaacgagagaccaatcattcttgccctatcgaacccaacatcacaatctgaatgcacagctgagcaagcttacacatggagcaagggacaagcagtgtttgcgactgggagtccatttgatcctgtggagtacaatggcaagatacatgttcccggacaggcaaacaatgcctatatcttcccagggtttggcctcggcgtggtgatgtctggagctatccgcgttcatgacgacatgcttctggcagcatcggaggctctggccca

SEQ ID NO: 6028 - DNA, 301 bp, Zea mays
  Clone ID: 700457069H1
agttgctgcagtcggagtacggttcgtagtcggttcaacatttcaattaaccatggggtgcaggtgcatgagccactgtacaacacacttagatgctgttaatgctatcaaaccaacagtgttgattggcacatccgggaaggggcaaactttcacaaaagacgttgttgaagcatctcctcatttaacgagagaccaatcattcttgccctatcgaacccaacatcacaatctgaatgcacagctgagcaagcttacacatggagcaagggacaagcagtgtttgcgactagagtccatt

SEQ ID NO: 6029 - DNA, 271 bp, Zea mays
  Clone ID: 700457021H1
gtcccttcaacacttcaagaaaccatgggctcatgagcataaaccactcagcaacctcttagatgctgttaatgctatcaaaccaacagtgttgattggcacatccgggaaggggcaaactttcacaaaagacgttgttgaagcatctcctcatttaacgagagaccaatcattcttgccctatcgaacccaacatcacaatctgaatgcacagctgagcaagcttacacatggagcaagggacaagcagtgtttgcgactggagtccatt

SEQ ID NO: 6030 - DNA, 277 bp, Zea mays
  Clone ID: 701181152H1
atccgcgttcatgacgacatgcttctggcagcatcggaggctctggcccagcaggtcacagaagaaaattttgagaaggggctgatttatcctcccttctcaaacatcaggaagatctctgcccacattgcagccagcgttgcagcaaaggcatatgaacttggtttggcaagtagggcgcctccggccaaaggacctggtgaaatatgcagagagttgcatgtacagccccatctaccgcaactaccgttgaattcggatcaactccagttatgtg

SEQ ID NO: 6031 - DNA, 270 bp, Zea mays
  Clone ID: 700445983H1
cctcggcgtggtgatgtctggagctatccgcgttcatgacgacatgcttctggcagcatcggaggctctggcccagcaggtcacagaagaaaattttgagaaggacctgatttatcctcccttctcaaacatcaggaagatctctgcccacattgcagccagcgttgcagcaaaggcatatgagggtggtttggcaagtaggcgccctcggccaaaggacctgtgaaatatgcagagagttgcatgtacagccccatctaccgcaactac

SEQ ID NO: 6032 - DNA, 225 bp, Zea mays
  Clone ID: 700142607H2
gacatgcttctggcagcatcggaggctctggcccagcaggtcacagaagaaaattttgagaaggggctgatttatcctcccttctcaaacataaggaagatctctgcccacattgcagccagcgttgcagcaaaggcatatgaacttggtttggcaagtaggcgccctcggccaaaggacctggtgaaatatgcagagagctgcatgtacagccccatctaccgc

SEQ ID NO: 6033 - DNA, 335 bp, Zea mays
  Clone ID: 700097657H1
aattgatgttggtacaaataacgagaaactgcttaatgatgagttctacattggactccggcaaaaacgtgcgactggcgaggagtatgatgagcttattgaagagttcatgtctgctgttaagcaattctatggtgagaaagtcctcattcagtttgaggactttgccaatcacaatgcctttgatttgcttgaaaaatatagcaagagccatcttgttttcaatgatgatatccagggcacagcatcagtggtccttgcaggtttgttagcagcactcaagatggttggtgggaccctggcagagcagacgtatttgttccttggtgctgggg

SEQ ID NO: 6034 - DNA, 326 bp, Zea mays
  Clone ID: 700098574H1
gcgactggcgaggagtatgatgagcttattgaagagttcatgtctgctgttaagcaattctatggtgagaaagtcctcattcagtttgaggactttgccaatcataatgcctttgatttgcttgaaaaatatagcaagagccatcttgttttcaatgatgatatccagggcacagcatcagtggtccttgcaggtttgttagcagcactcaagatggttggtgggaccctggcagagcagacttatttgttccttggtgctggggaggctggaactggtattgcagaacttattgctcttgagatttcgaaacagacgaatgctcc

SEQ ID NO: 6035 - DNA, 289 bp, Zea mays
  Clone ID: 700099850H1
aaatatagcaagagccatcttgttttcaatgatgatatccagggcacagcatcagtggtccttgcaggtttgttagcagcactcaagatggttggtgggaccctggcagagcagacgtatgtgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctcccttcagccattcaaga

SEQ ID NO: 6036 - DNA, 309 bp, Zea mays
  Clone ID: 700097455H1
cagtttgaggactttgccaatcataatgcctttgatttgcttgaaaaatatagcaagagccatcttgttttcaatgatgatatccagggcacagcatcagtggtccttgcaggtttgttagcagcactcaagatggttggtgggaccctggcagagcagacttatttgttccttggtgctggggaggctggaactggtattgcagaacttattgctcttgagatttcgaaacagacgaatgctccaattgaagagtgccgcaagaaggtttggctggtggactcaaagggtttgattgttgactctcgt

SEQ ID NO: 6037 - DNA, 315 bp, Zea mays
  Clone ID: 700097222H1
ctcttggaggagttgacccatcagtttgcttgcctatcacaattgatgttggtacaaataacgagaaactgcttaatgatgagttctacattggactccggcaaaaacgtgcgactggcgaggagtatgatgagcttattgaagagttcatgtctgctgttaagcaattctatggtgagaaagtcctcattcagtttgaggactttgccaatcataatgcctttgatttgcttgaaaaatatagcaagagccatcttgttttcaatgatgatatccagggcacagcatcagtggtccttgcaggtttgttagcag

SEQ ID NO: 6038 - DNA, 313 bp, Zea mays
  Clone ID: 700097391H1
ctcttggaggagttgacccatcagtttgcttgcctatcacaattgatgttggtacaaataacgagaaactgcttaatgatgagttctacattggactccggcaaaaacgtgcgactggcgaggagtatgatgagcttattgaagagttcatgtctgctgttaagcaattctatggtgagaaagtcctcattcagtttgaggactttgccaatcataatgcctttgatttgcttgaaaaatatagcaagagccatcttgttttcaatgatgatatccagggcacagcatcagtggtccttgcaggtttgttagc

SEQ ID NO: 6039 - DNA, 304 bp, Zea mays
  Clone ID: 700097849H1
gagaaagtcctcattcagtttgaggactttgccaatcacaatgcctttgatttgcttgaaaaatatagcaagagccatcttgttttcaatgatgatatccagggcacagcatcagtggtccttgcaggactgttagcagcactcaagatggttggtgggaccctggcagagcagacgtatttgttccttggtgctggggaggctggaactggtattgcagaacttattgctcttgagatttcgaaacagacgaatgctccaattgaagagtgccgcaagaaggtttggctggtggactcaaagg

SEQ ID NO: 6040 - DNA, 297 bp, Zea mays
  Clone ID: 700101666H1
attcagtttgaggactttgccaatcacaatgcctttgatttgcttgaaaaatatagcaagagccatcttgttttcaatgatgatatccagggcacagcatcagtggtccttgcaggtttgttagcagcactcaagatggttggtgggaccctggcagagcagacgtatttgttccttggtgctggggaggctggaactggtattgcagaacttattgctcttgagatttcgaaacagacgaatgctccaattgaagagtgccgcaagaaggtttggctggtggactcaaagggtttg

SEQ ID NO: 6041 - DNA, 304 bp, Zea mays
  Clone ID: 700099890H1
atcttttcactgtcaaacccaacctcgcattctgaatgcactgctgaacaagcatatacctggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggacatgcttctcgccgcctcgaaagcgctagctgatcaggccacacaggacaacttcgagaagggctccatcttcccacccttcacca

SEQ ID NO: 6042 - DNA, 306 bp, Zea mays
  Clone ID: 700097237H1
ggacgaccacagggtctgtatgtcagcctgaaggacaaggggaaggtcctagaagttctaaggaactggccacataggaacattcaagttatctgtgttactgatggtgagcgaatcttgggacttggagatttgggttgtcagggaatgggaattcctgtaggcaaacttgctctatacactgctctaggaggagttgacccatcagtttgcttgcctatcacaattgatgttggtacaaataacgagaaactgcttaatgatgagttctacattggactccggcaaaacgtgcgactggcgagg

SEQ ID NO: 6043 - DNA, 288 bp, Zea mays
  Clone ID: 700101278H1
atagctatgatgaaccttcaggaaacggacgagaggcttttctacaagcttttaattgataatgtggtggagctgcttccttttgtttacacaccaactgtaggtgaggcctgccagaagtatgggtccatctttggacgaccacagggtctgtatgtcagcctgaaggacaaggggaaggtcctagaagttctaaggaactggccacataggaacattcaagttatctgtgttactgatggtgagcgaatcttgggacttggagacttgggttgtcagggaatggga

SEQ ID NO: 6044 - DNA, 290 bp, Zea mays
  Clone ID: 700101431H1
tctacattggactccggcaaaaacgtgcgactggcgaggagtatgatgagcttattgaagagttcatgtctgctgttaagcaattctatggtgagaaagtcctcattcagtttgaggactttgccaatcacaatgcctttgatttgcttgaaaaatatagcaagagccatcttgttttcaatgatgatatccagggcacagcatcagtggtccttgcaggtttgttagcagcactcaagatggttggtgggaccctggcagagcagacgtatttgttccttggtgctggg

SEQ ID NO: 6045 - DNA, 289 bp, Zea mays
  Clone ID: 700100860H1
cccttttgagggatccacaccacaacaagggtcttgctttcacatatgaggaaagggatggacactacttgcgtggactgcttcctccggcagtactatctcaggaactccaaattaagaagttcatgaacaccctgcggcagtaccagacccctttgcagcggtatatagctatgatgaaccttcaggaaacggacgagaggcttttctacaagcttttaattgataatgtggtggagctgcttccttttgtttacacaccaactgtaggtgaggcctgccagaagta

SEQ ID NO: 6046 - DNA, 284 bp, Zea mays
  Clone ID: 700581218H1
ggctggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaaccttgggcgcattcgaacgagcccttgaaaaccttgtatgatgctgttcagtccatcaaacctacagttctgatcgggacatctggagttggaagaacattcacaaaagaaatcattgaggccatgtcttcct

SEQ ID NO: 6047 - DNA, 284 bp, Zea mays
  Clone ID: 700101446H1
tgctgttaagcaattctatggtgagaaagtcctcattcagtttgaggactttgccaatcataatgcctttgatttgcttgaaaaatatagcaagagccatcttgttttcaatgatgatatccagggcacagcatcagtggtccttgcaggtttgttagcagcactcaagatggttggtgggaccctggcagagcagacttatttgttccttggtgctggggaggctggaactggtattgcagaacttattgctcttgagatttcgaaacagacgaatgctccaa

SEQ ID NO: 6048 - DNA, 278 bp, Zea mays
  Clone ID: 700044315H1
aaaagaaatcattgaggccatgtcttccttcaacgagaggcctatcatcttttcactgtcaaacccaacctcgcattctgaatgcactgctgaacaagcatatacatggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggacatgcttctcgccg

SEQ ID NO: 6049 - DNA, 287 bp, Zea mays
  Clone ID: 700045610H1
gacgaatgctccaattgaagagtgccgcaagaaggtttggctggtggactcaaagggtttgattgttgactctcgtaaaggctctcttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctg

SEQ ID NO: 6050 - DNA, 282 bp, Zea mays
  Clone ID: 700434125H1
ctctcttcagccattcaagaaaccttgggctaatgagcacgagcccttgaaaaccttgtatgatgctgttcagtccatcaaacctacagttctgatcgggacatctggagttggaagaacattcacaaaagaaatctttgaggccatgtcttccttcaacgagaggcctatcatcttttcatcgtcaaacccaacctcgcattctgaatgcactgctgaacaagcatatacatggagtcagggccgttcaatctttgccagtggcagtccatttgcccccgt

SEQ ID NO: 6051 - DNA, 280 bp, Zea mays
  Clone ID: 700041705H1
ctccatcttcccacccttcaccagcatcagaaagatctctgcgcacatcgctgcagccgtggctgcaaaagcctacgagctcggtctggcgacccgtctgcctccccccagcgacctggtgaaatatgcagagaactgcatgtacactcccgtctaccgcaactaccggtagtgctgcggggatcaattttgcagtaataaaaaatctatcaacgcggatggtactctgttgtttatagtccctgctgctaaccacccttgttgctggtgctgctggaga

SEQ ID NO: 6052 - DNA, 314 bp, Zea mays
  Clone ID: 700104088H1
ggctgctgttaacaaatctacggcgagaaagtcctcattcagtttgaggacttcgcgaatcataatgcttttaatttgcttgcaaaatatagcaagagccatcttgttttcaatgatgacatccagggcacagcatcagtggtccttgcaggtttgttagcagcactcaacgtggttggtgggaccttggcagagcacacttatttattccttggtgctggggaggctggaactggtattgcagaactcattgctcttgagatttcaaaacagacgtcggctccaattgaagagtgccgcaagaagatttggtt

SEQ ID NO: 6053 - DNA, 336 bp, Zea mays
  Clone ID: 700614919H1
cacatcacaacaagggtcttgctttcacggagaaggagagggatgcacaccacttgcgtgggctgcttcctcctgcagttgttcctcaagaactccaaattaagaagatcatgcacaacctgcggcagtaccaggtccctttgcagcgctatatggccatgatggaccttcaggagaggcacgagaggctttctacaagcttttactcgataacgtggaggagctgcttcctgtggtttatacaccaactgtaggtgaggcctaccagaagtatgggcccatctttcgacacacacagggtctgtatcagcttgagggacaaagggaaggtcctag

SEQ ID NO: 6054 - DNA, 330 bp, Zea mays
  Clone ID: 700613108H1
ccacatcacaacaagggtcttgctttcacggagaaggagagggatgcacaccacttgcgtgggctgcttcctcctgcagttgttcctcaagaactccaaattaagaagatcatgcacaacctgcggcagtaccaggtccctttgcagcgctatatggccatgatggaccttcaggagaggaacgagaggcttttctacaagcttttaattgataacgtggaggagctgcttcctgtggtttatacaccaactgtaggtgaggcctgccagaagtatgggtccatctttcgacaaccacagggtctgtatgtcagcttgagggacaaaggg

SEQ ID NO: 6055 - DNA, 274 bp, Zea mays
  Clone ID: 700042025H1
agctgcttccttttgtttacacaccaactgttggtgaggcctgccagaagtatgggtccatctttggacgaccacagggtctgtatgtcagcctgaaggacaaggggaaggtcctagaagttctaaggaactggccacataggaacattcaagttatctgtgttactgatggtgagcgaatcttgggacttggagatttgggttgtcagggaatgggaattcctgtaggcaaacttgctctatacactgctcttggaggagttgacccatcagt

SEQ ID NO: 6056 - DNA, 295 bp, Zea mays
  Clone ID: 700467944H1
gaggcttttctacaagcttttaattgataacgtggaggagctgcttcctgtggtttatacaccaactgtaggtgaggcctgccagaagtatgggtccatctttcgacaaccacagggtctgtatgtcagcttgagggacaaagggaaggtcctagaagttctaaagaactggccacataggaacattcaagttatctgtgttactgatggtgagcgaatcttgggacttggagatttgggttctcagggaatgggaattcctgtaggcaaacttgctctatacactgctcttgga

SEQ ID NO: 6057 - DNA, 336 bp, Zea mays
  Clone ID: 700617354H1
caaacctacagttctgattgggacgtctggagttggaagaacattcacaaaagaagttgttgaggccatggcttccttcaatgagaggcctatcatcttttcactgtcaaatccaacctctcattctgaatgtactgctgaagaagcatataactggactcagggtcgtgcaatatttgccagtggcagtccatttgaccctgtggagtacgatgggaaggtttttgtacctggacagtcgaacaacgcctacattttccctggattcggcctcggtcttgttatctctggagccatccgtgtccacgaggacatgcttcttgccgcctcggaagc

SEQ ID NO: 6058 - DNA, 309 bp, Zea mays
  Clone ID: 700095156H1
ccggcaaaaacgtgcactggcgaggagtatcatgagcttatggaagagttcatggctgctgttaagcaaatctacggcgagaaagtcctcattcagtttgaggacttcgcgaatcataatgcttttaatttgcttgcaaaatatagcaagagccatcttgttttcaatgatgacatccagggcacagcatcagtggtccttgcaggtttgttagcagcactcaaggtggttggtaggaccttggcagagcacacttatttattccttggtgctggggaagctggaactggtattgcagaactcattgct

SEQ ID NO: 6059 - DNA, 307 bp, Zea mays
  Clone ID: 700448457H1
ggggcggctggaactggtattgcagaacttattgctcttgagatttcgaaacagacgaatgctccaattgaagagtgccgcaagaaggtttggctagtggactcaaagggtttgattgttgactctcgtaaaggctcccttcagccattcaagaaaccttgggcgcctgagcacgagcccttgaaaaccttgtatgatgctgttcagaccatcaaacctacagttctgatcgggacatctggagttggaaaaacattcacaaaagcaatcattgaggccatgtcttccttcaacgagagagctatca

SEQ ID NO: 6060 - DNA, 284 bp, Zea mays
  Clone ID: 700581224H1
tggccgttcgatctttgccagtggcagtccatttgcccccgtggagtacgaaggaaagacttttgtgcctgggcagtcgaacaatgcctacattttccctggactcggcctcggtcttgtgatctctggggccgtccgtgtccacgaggacatgcttctcgccgcctcgaaagcgctagctgatcaggccacacaggacaacttcgagaagggctccatcttcccacccttcaccagcatcagaaagatctctgcgcacatcgctgcagccgtggctgcaaaag

SEQ ID NO: 6061 - DNA, 273 bp, Zea mays
  Clone ID: 700426724H1
cccatacttctggcaggcctcaccaacagttggtgtgtaaacaaaaggaagcagctccaccacattatcaattaaaagcttgtagaaaagcctctcgtccgtttcctgaaggttcatcatagctatataccgctgcaaaagggtctggtactgccgcagggtgttcatgaacttcttaatttggagttcctgagatagtactgccggaggaagcagtccacgcaagtagtgtccatccctttcctcctctgtgaaagcagagaccttgttgtg

SEQ ID NO: 6062 - DNA, 303 bp, Zea mays
  Clone ID: 700105096H1
ggaggagctgcttcctgtggtttatacaccaactgtaggtgaggcctgccagaagtatgggtccatctttcgacaaccacagggtctgtatgtcagcttgagggacaaagggaaggtcctagaagttctaaggaactggccacataggaacattcaagttatctgtgttactgatggtgagcgaatcttgggacttggagatttgggttctcagggaatgggaattcctgtaggcaaacttgctctatacactgctcttggaggagttcgtccatcagcttgtttgcctatcacaatcgatgt

SEQ ID NO: 6063 - DNA, 264 bp, Zea mays
  Clone ID: 700045272H1
gccgcaagaaggtttggctggtggactcaaagggtttgattgttgactctcgtaaaggctctcttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctg

SEQ ID NO: 6064 - DNA, 260 bp, Zea mays
  Clone ID: 700577375H1
ggaggctggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaa

SEQ ID NO: 6065 - DNA, 260 bp, Zea mays
  Clone ID: 700044113H1
ttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgag

SEQ ID NO: 6066 - DNA, 265 bp, Zea mays
  Clone ID: 700042068H1
cttcaacgagaggcctatcatcttttcactgtcaaacccaacctcgcattctgaatgcactgctgaacaagcatatacatggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggacatgcttctcgccgcatcgaaagcgcta

SEQ ID NO: 6067 - DNA, 266 bp, Zea mays
  Clone ID: 700582457H1
cttgttttcaatgatgatatccagggcacagcatcagtggtccttgcaggtttgttagcagcactcaagatggttggtgggaccctggcagagcagacttatttgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctcccttcagccatt

SEQ ID NO: 6068 - DNA, 271 bp, Zea mays
  Clone ID: 700580693H1
attcacaaaagaaatcattgaggccatgtcttccttcaacgagaggcctatcatcttttcattgtcaaacccaacctcgcattctgaatgcactgatgaacaagcatatacctggagtcagggccgttcgatctttgccagtggcagtccatttgcccccgtggagtacgaaggaaagacttttgtgcctgggcagtcgaacaatgcctacattttccctggactcggcctcggtcttgtgatctctggggccgtccgtgtccacgaggac

SEQ ID NO: 6069 - DNA, 278 bp, Zea mays
  Clone ID: 700577922H1
gaaggtttggctggtggactcaaagggtttgattgttgactctcgtaaaggctcccttcagccattcaagaaaccttgggcgcatgagcacgagcccttgaaaaccttgtatgatgctgttcaatccatcaaacctacagttctgatcgggacatctggagtcggacgaacattcacaaaagaaatcattgaggccatgtcttccttcaacgagaggcctatcatcttttcactgtcaaactcaacctcgcattctgaatgcactgctgaacaagcat

SEQ ID NO: 6070 - DNA, 259 bp, Zea mays
  Clone ID: 700043222H1
aaacagacgaatgctccaattgaagagtgccgcaagacggtttggctggtggactcaaagggtttgattgttgactctcgtaaaggctctcttcagccattcaagaaaccttgggcgcatgagcacgagcccttgaaaaccttgtatgatgctgttcagtccatcaaacctacagttctgatcgggacatctggagttggaagaacattcacaaaagaaatcattgaggtcatgtcttccttcaacgagaggcctatca

SEQ ID NO: 6071 - DNA, 296 bp, Zea mays
  Clone ID: 700103882H1
gaagagtgccgcaagaagatttggttggtggactcaaagggtttgattgttgactctcgtaaaaactccgttcagtcattcaaaaaaccttgggcacatgagcatgagcccttgacaaccttgtacgatgctgttcagtccatcaaacctacagttctgattgggacgtctggagttggaagaacattcacaaaagaagttgttgaggccatggcttccttcaatgagaggcctatcatcttttcactgtcaaatccaacctctcattctgaatgtactgctgaagaagcatataa

SEQ ID NO: 6072 - DNA, 263 bp, Zea mays
  Clone ID: 700579779H1
cttctcgccgcctcgaaagcgctagctgatcaggccacacaggacaacttcgagaagggctccatcttcccacccttcaccagcatcagaaagatctctgcgcacatcgctgcagccgtggctgcaaaagcctacgagctcggtctggcgacccgtctgcctccccccagcgacctggtgaaatatgcagagaactgcatgtacactcccgtctaccgcaactaccggtagtgctgcggggatcaattttgcagtaataaaaa

SEQ ID NO: 6073 - DNA, 351 bp, Zea mays
  Clone ID: 700615410H1
atccagcatggtccctcagtcggatcggctcgagtgagcttatggaagagttcatggctgctgttaagcaaatctacggcgagaaagtcctcattcagtttgaggacttcgcgaatcataatgcttttaatttgcttgcaaaatatagcaagagccatcttgttttcaatgatgacatccagggcacagcatcagtggtccttgcaggtttgttagcagcactcaaggtggttggtgggaccttggcagagcacacttatttattccttggtgctggggaggctggaactggtattgcagaactcattgctcttgagatttcaaaacagacgtcggctccaattgaagagt

SEQ ID NO: 6074 - DNA, 256 bp, Zea mays
  Clone ID: 700439978H1
gggaccctggcagagcagacttatttgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtccatcaaac

SEQ ID NO: 6075 - DNA, 258 bp, Zea mays
  Clone ID: 700045066H1
cttgggacttggagatttgggttgtcagggaatgggaattcctgtaggcaaacttgctctatacactgctctaggaggagttgacccatcagtttgcttgcctatcacaattgatgttggtacaaataacgagaaactgcttaatgatgagttctacattggactccggcaaaaacgtgcgactggcgaggagtatgatgagcttattgaagagttcatgtctgctgttaagcaattctatggtgagaaagtcctcat

SEQ ID NO: 6076 - DNA, 262 bp, Zea mays
  Clone ID: 700439024H1
ggtggagctgcttccttttgtttacacaccaactgtaggtgaggcctgccagacgtatgggtccatctttggacgaccacagggtctgtatgtcagcctgaaggacaaggcgaaggtcctagaagttctaaggaactggccacataggaacattcaagttatctgtgttactgatggtgagcgaatcttgggacttggagatttgggttgtcaggaatgggaattcctgtaggcaaacttgctctatacactgctctaggag

SEQ ID NO: 6077 - DNA, 308 bp, Zea mays
  Clone ID: 700263465H1
aaaaccttgggcacatgagcatgagcccttgacaaccttgtacgatgctgttcagtccatcaaacctacagttctgattgggacgtctggagttggaagaacattcacaaaagaagttgttgaggccatggcttccttcaatgagaggcctatcatcttttcactgtcaaatccaacctctcattctgaatgtactgctgaagaagcatataactggactcagggtcgtgcaatatttgccagtggcagtccatttgaccctgtggagtacgatgggaaggtttttgtacctggacagtcgaacaacg

SEQ ID NO: 6078 - DNA, 276 bp, Zea mays
  Clone ID: 700046417H1
aacattggtacccaagattgtttgctttcacaacgttacaacatatatatatcatatatgcatggacaggtacaatgcctctccagcagcaccagcaacaagggtggttagcagcagggactataaacaacagagtaccatccgcgttgatagattttttattactgcaaaattgatccccgcagcactaccggtagttgcggtagacgggagtgtacatgcagttctctgcatatttcaccaggtcgctggggggaggcagacgggtcgccagac

SEQ ID NO: 6079 - DNA, 287 bp, Zea mays
  Clone ID: 700347845H1
ggaacattcaagttatctgtgttactgatggtgagcgaatcttgggacttggagatttgggttctcagggaatgggaattcctgtaggcaaacttgctctatacactgctcttggaggagttcgtccatcagcttgtttgcctatcacaatcgatgttggcacaaataatgagaaactgcttaatgatgagttttacattggactccggcaaaaacgtgcaactggcgaggagtatcatgagcttatggaagagttcatggctgctgttaagcaaatctacggcgag

SEQ ID NO: 6080 - DNA, 261 bp, Zea mays
  Clone ID: 700043227H1
cgtcaaacccaacctcgcattctgaatgcactgctgaacaagcatatacatggcgtcagggccgttcaatctttgccagtcgcagtccatttgcccccgtggagtacgaaggacagacttttgtgcctgggcagtcgaacaatgcctacattttccctggactcggcctcggtcttgtgatctctggagccgtccgtgtccacgaggacatgcttctcgccgcatcgaaagcgctactgactcaggccacacaggacaact

SEQ ID NO: 6081 - DNA, 272 bp, Zea mays
  Clone ID: 700469957H1
agctgcttcctgtggtttatacaccaactgtaggtgaggcctgccagaagtatgggtccatctttcgacaaccacagggtctgtatgtcagcttgagggacaaagggaaggtcctagaagttctaaggaactggccacataggaacattcaagttatctgtgttactgatggtgagcgaatcttgggacttggagatttgggttctcagggaatgggaattcctgtaggcaaacttgctctatacactgctcttggaggagttcgtccatca

SEQ ID NO: 6082 - DNA, 251 bp, Zea mays
  Clone ID: 700044725H1
gcagccgtggctgcaaaagcctacgagctcggtctggcgacccgtctgcctccccccagcgacctggtgaaatatgcagagaactgcatgtacactcccgtctaccgcaactaccggtagtgctgcggggatcaattttgcagtaataaaaaatctatcaacgcggatggtactctgttgtttatagtccctgctgctaaccacccttgttgctggtgctgctggagaggcattgtacctgtccatgcata

SEQ ID NO: 6083 - DNA, 311 bp, Zea mays
  Clone ID: 700615834H1
cgcgaatcataatgcttttaatttgcttgcaaaatatagcaagagccatcttgttttcaatgatgacatccagggcacagcatcagtggtccttgcaggtttgttagcagcactcaaggtggttggtgggaccttggcagagcacacttatttattccttggtgctggggaggctgaactggtattgcagaactcattgctcttgagatttcaaaacagacgtcggctccaattgaagagtgccgcaagaagatttggttggtggactcaaagggtttgattgttgactctcgtaaaaactccgttcagtc

SEQ ID NO: 6084 - DNA, 280 bp, Zea mays
  Clone ID: 700224349H1
tgctgttaagcaaatctatggcgagaaagtcctcattcagtttgaggacttcgcgaatcataatgcttttaatttgcttgcaaaatatagcaagagccatcttgttttcaatgatgacatccagggcacagcatcagtggtccttgcaggtttgttagcggcactcaaggtggttggtgggaccttggcagagcacacttatttattccttggtgctggggaggctggaactggtattgcagaactcattgctcttgagatttcaaaacagacgtcggct

SEQ ID NO: 6085 - DNA, 262 bp, Zea mays
  Clone ID: 700438840H1
ctcaaagggtttgattgttgactctcgtaaaggctcccttcagccattcaagaaaccttgggcgcatgagcacgagcccttgaaaaccttgtatgatgctgttcagtccatcaaacctacagttctgatcgggaatctggagttggaagaacattcacaaaagaaatcattgaggccatgtcttccttcaacgagaggcctatcatcttttcactgtcaaacccaacctcgcattctgaatgcactgctgaacaagcatata

SEQ ID NO: 6086 - DNA, 291 bp, Zea mays
  Clone ID: 700465188H1
ctcaagaactccaaattaagaagatcatgcacaacctgcggcagtaccaggtccctttgcagcgctatatggccatgatggaccttcaggagaggaacgagaggcttttctacaagcttttaattgataacgtggaggagctgcttcctgtggtttatacaccaactgtaggtgaggcctgccagaagtatgggtccatctttcgacaaccacagggtctgtatgtcagcttgagggacaaagggaaggtcctagaagttctaaggaactggccacataggaacattcaag

SEQ ID NO: 6087 - DNA, 272 bp, Zea mays
  Clone ID: 700223493H1
ggccatgatggaccttcaggagaggaacgagaggcttttctacaagcttttaattgataacgtggaggagctgcttcctgtggtttatacaccaactgtaggtgaggcctgccagaagtatgggtccatctttcgacaaccacagggtctgtatgtcagcttgagggacaaggggaaggtcctagaagttctaaggaactggccacataggaacattcaagttatctgtgttactgatggtgagcgaatcttgggacttggagatttgggtt

SEQ ID NO: 6088 - DNA, 254 bp, Zea mays
  Clone ID: 700442430H1
atctctgcgcacatcgatgcagccgtggctgcaaaagcctacgagctcggtctggcgatccgtctgcatctccccagcgatctggtgaaatatgcagagaactgcatgtacactcccgtctaccgcaactaccggtagtgctgcggggatcaattttgcagtaataaaaatctatcaacgcggatggtactctgttgtttatagtccctgctgctaaccacccttgttgctggtgctgctggagatgcattgta

SEQ ID NO: 6089 - DNA, 275 bp, Zea mays
  Clone ID: 700479665H1
cgcgaatcataatgcttttaatttgcttgcaaaatatagcaagagccatcttgttttcaatgatgacatccagggcacagcatcagtggtccttgcaggtttgttagcggcactcaaggtggttggtgggaccttggcagagcacacttatttattccttggtgctggggaggctggaactggtattgcagaactcattgctcttgagatttcaaaacagacgtcggctccaattgaagagtgccgcaagaagatttggttggtggactcaaagg

SEQ ID NO: 6090 - DNA, 258 bp, Zea mays
  Clone ID: 700242318H1
acgagaggcttttctacaagcttttaattgataacgtggaggagctgcttcctgtggtttatacaccaactgtaggtgaggcctgccagaagtatgggtccatctttcgacaaccacagggtctgtatgtcagcttgagggacaaggggaaggtcctagaagttctaaggaactggccacataggaacattcaagttatctgtgttactgatggtgagcgaatcttgggacttggagatttgggttctcagggaatgg

SEQ ID NO: 6091 - DNA, 296 bp, Zea mays
  Clone ID: 700262339H1
gctctatacactgctcttggaggagttcgtccatcagcttgtttgcctatcacaatcgatgttggcacaaataatgagaaactagttaatgatgagttttacattggactccggcaaaaacgtgcaactggcgaggagtatcatgagcttatggaagagttcatggctgctgttaagcaaatctatggcgagaaagtcctcattcagtttgaggacttcgcgaatcataatgcttttaatttgcttgcaaaatatagcaagagccatcttgttttcaatgatgacatccagggcac

SEQ ID NO: 6092 - DNA, 269 bp, Zea mays
  Clone ID: 700551426H1
gttctgcaataccagttccagcctccccagcaccaaggaataaataagtgtgctctgccaaggtcccaccaaccaccttgagtgccgctaacaaacctgcaaggaccactgatgctgtgccctggatgtcatcattgaaaacaagatggctcttgctatattttgcaagcaaattaaaagcattatgattcgcgaagtcctcaaactgaatgaggactttctcgccatagatttgcttaacagcagccatgaactcttccataagctca

SEQ ID NO: 6093 - DNA, 298 bp, Zea mays
  Clone ID: 700580501H1
gcaaaaacgtgcaactggcgaggagtatcatgagcttatggaagagttcatggctgctgttaagcaaatctatggcgagatagtcctcattcagtttgaggacttcgcgaatcataatgcttttaatttgcttgcaaaatatagcaagagccatctgtgttcaatgatgacatccagggcacagcatcagtggtccttgcaggtttgttagcggcactcaaggtggttggtgggaccttggcagagcacacttatttattccttggtgctggggaggctggaactggtattgcagaat

SEQ ID NO: 6094 - DNA, 273 bp, Zea mays
  Clone ID: 700430624H1
cacgaggacatgcttctcgccgcctcgaaagcgctactgatcaggccacacaggacaacttcgagaagggctccatcttcccacccttcaccagcatcagaaagatctctgcgcacatcgctgcagccgtgcccgcaaaagcctacgagctcggtctggcgacccgtctgcctccccccagcgacctggtgaaatatgcagagaactgcatgtacactcccgtctagcgcaactaccggtagtgctgcggggatcaatttggccgtaataaaa

SEQ ID NO: 6095 - DNA, 283 bp, Zea mays
  Clone ID: 700798989H1
cgatgctgttcagtccatcaaacctacagttctgattgggacgtctggagttggaagaacattcacaaaagaagttgttgaggccatggcttccttcaatgagaggcctatcatcttttcactgtcaaatccaacctctcattctgaatgtactgctgaagaagcatataactggactcagggtcgtgcaatatttgccagtggcagtccatttgaccctgtggagtacgatgggaaggtttttgtacctggacagtcgaacaacgcctacattttccctgga

SEQ ID NO: 6096 - DNA, 249 bp, Zea mays
  Clone ID: 700438471H1
cggaattcctgtaggcaaacttgctctatacactgctctaggaggagttgacccatcagtttgcttgcctatcacaattgatgttggtacaaataacgagaaactgcttaatgatgagttctacattggactccggcaaaaacgtgcgactggcgaggagtatgatgagcttattgaagagttcatgtctgctgttaagcaattctatggtgagaaagtcctcattcagtttgaggactttgccaatca

SEQ ID NO: 6097 - DNA, 317 bp, Zea mays
  unsure (1)...(317): unsure at all n locations
  Clone ID: 700572903H1
ctcggtcttgttatctctggagccatccgtgtccacgaggacatgcttcttgccgcctcggaagcactagctgctcaggccacacaggagaacttcgacaagggatcaatcttcgcgcccttcaccaacattagaaagatctctgcgcgcattgccgcagccgtggctgcaaaagcttatgaactcggtttgcgacccgtctgcctcccccaagggacctggtgaaatatgcacagagctgcatgtacactcctgtctaccgtaactaccgatagtgctgctgggatcaattctgcagtaatanaatatgtcgacgc

SEQ ID NO: 6098 - DNA, 287 bp, Zea mays
  Clone ID: 700083411H1
aatgcttttaatttgcttgcaaaatatagcaagagccatcttgttttcaatgatgacatccagggcacagcatcagtggtccttgcaggtttgttagcagcactcaaggtggttggtgggaccttggcagagcacacttatttattccttggtgctggggaggctggaactggtattgcagaactcattgctcttgagatttcaaaacagacgtcggctccaattgaagagtgccgcaagaaagattggtttgtggactcaaagggtttgattgttgactctcgtaa

SEQ ID NO: 6099 - DNA, 295 bp, Zea mays
  Clone ID: 700442605H1
ccgccaccgaggagctgcccatcatgccctgggtcttctccgtcgcaagcggttacaccctcttgagggatccacatcacaacaagggtcttgctttcacggagaaggacatggatgcacaccacttgcgtgggctgcttcctcctgcagttgttcctcaagaactccaaattaagaagatcatgcacaacctgcggcagtaccaggtccctttgcagcgctatatggccatgatggaccttcaggagaggaacgagaggcttttctacaagcttttaattgataacgtggaggg

SEQ ID NO: 6100 - DNA, 264 bp, Zea mays
  Clone ID: 700224532H1
gttttcaatgatgacatccagggcacagcatcagtggtccttgcaggtttgttagcagcactcaaggtggttggtaggaccttggcagagcacacttatttattccttggtgctggggaggctggaactggtattgcagaactcattgctcttgagatttcaaaacagacgtcggctccaattgaagagtgccgcaagaagatttggttggtggactcaaagggtttgattgttgactctcgtaaaaactccgttcaatcattc

SEQ ID NO: 6101 - DNA, 314 bp, Zea mays
  Clone ID: 700572585H1
ggttcgtaggaccttggcagagcacacttatttattccttggtgctggggaggctggcactggtattgcagaactcattgctcttgagatttcagaacagacgtcggctccaattgaagagtgccgcaagaagatttggttggtggactcaaagggtatgattgttgactctcgtaaaaactccgttcaatcattcataaaaccttgggcacatgagcatgagcccttgacaaccttgtacgatgctgatcagtccatcaaacctacagttctgattgggacgtctggagttggaagagcattcacaaaagaag

SEQ ID NO: 6102 - DNA, 276 bp, Zea mays
  Clone ID: 700083289H1
cactgctcttggaggagttcgtccatcagcttgtttgcctatcacaatcgatgttggcacaaataatgagaaactgcttaatgatgagttttacattggactccggcaaaaacgtgcaactggcgaggagtatcatgagcttatggaagagttcatggctgctgttaagcaaatctatggcgagaaagtcctcattcagtttgaggacttcgcgaatcataatgcttttaatttgcttgcaaaatatagcaagagccatcttgttttcaatgatga

SEQ ID NO: 6103 - DNA, 282 bp, Zea mays
  Clone ID: 700612607H1
cgtccatcagcttgtttgcctatcacaatcgatgttggcacaaataatgagaaactgcttaatgatgagttttacattggactccggcaaaaacgtgcaactggcgaggagtatcatgagcttatggaagagttcatggctgctgttaagcaaatctacggcgagaaagtcctcattcagtttgaggacttcgcgaatcataatgcttttaatttgcttgcaaaatatagcaagagccatcttgttttcaatgatgacatccagggcacagcttcagtggtc

SEQ ID NO: 6104 - DNA, 270 bp, Zea mays
  Clone ID: 700429569H1
gaaaaatatagcaagagccatcttgttttcaatgatgatatccagggcacagcatcagtggtccttgcaggtttgttagcagcactcaagatggttggtgggaccctggcagagcagacgtatttgttccttggtgctggggaggctggaactggtattgcagaacttattgctcttgagatttcgaaacagacgaatctccaattgaagagtgccgcaagaaggtttggcatggtggactcaaagggtttgattgttgactctcgtaaa

SEQ ID NO: 6105 - DNA, 283 bp, Zea mays
  Clone ID: 700048813H1
gaagattgatcccttgtcgaagttctcctgtgtggcctgagcagctagtgcttccgaggcggcaagaagcatgtcctcgtggacacggatggctccagagataacaagaccgaggccaaatccagggaaaatgtaggcgttgttcgactgtccaggtacaaaaaccttcccatcgtactccacagggtcaaatggactgccactggcaaatattacacgaccctgagtccagttatatgcttcttcagcagtacattcagaatgagaggttggatttgacagt

SEQ ID NO: 6106 - DNA, 269 bp, Zea mays
  Clone ID: 700422905H1
cgtccgtgtccacgaggacatgcttctcgccgcctcgaaagcgctagctgatcaggccacacaggacaacttcgagaagggctccatcttcccacccttcaccagcatcagaaagatctctgcgcacatcgctgcagccgtggctgcaaaagcctacgagctcggtctggcgacccgtctgcctcccccctgcgacctggtgaaatatgcagagaactgcatgtacactcccgtctaccgcaactaccggtagtgcttcggggggatca

SEQ ID NO: 6107 - DNA, 301 bp, Zea mays
  Clone ID: 700106553H1
ggaccgtggtctgaatgtactgctgaagaagcatataactggactcatggtcgtgtaatatttgccagtggcagtccattacgccctgtggagtacgatgggaaggtttttgtacctggacagtcgaacaacgcctacattttccctggatttggcctcggtcttgttatctctggagccatccgtgtccacgaggacatgcttcttgccgcctcggaagcactagctgctcaggccacacaggagaacttcgataagggatcaatcttcccgcccttcaccaacattagaaagatctctg

SEQ ID NO: 6108 - DNA, 311 bp, Zea mays
  Clone ID: 700101622H1
cttaattaattattaagggagagccatctcgaaacatgcatatatagaaattatttttcctcagatctcgccgtcaagcatacatgcattcggacgagaggcttttctacaagcttttaattgataatgtggtggagctgcttccttttgtttacacaccaactgtaggtgaggcctgccagaagtatgggtccatctttggacgaccacagggtctgtatgtcagcctgaaggacaaggggaaggtcctagaagttctaaggaactggccacataggaacattcaagttatctgtgttactgatggtgag

SEQ ID NO: 6109 - DNA, 264 bp, Zea mays
  Clone ID: 700168331H1
gtcgaacaacgcctacattttccctggattcggcctcggtcttgttatctctggagccatccgtgtccacgaggacatgcttcttgccgcctcggaagcactagctgctcaggccacacaggagaacttcgacaagggatcaatcttcccgcccttcaccaacattagaaagatctctgcgcgcattgccgcagccgtggctgcaaaagcttatgaactcggtttggcgacccgtctgcctcccccaagggacctggtgaaata

SEQ ID NO: 6110 - DNA, 271 bp, Zea mays
  Clone ID: 701183573H1
atcttttcactgtcaaatccaacctctcattctgaatgtactgctgaagaagcatatcactggactcagggtcgtgcaatatttgccagtggcagtccatttgaccctgtggagtacgatgggaaggtttttgtacctggacagtcgaacaacgcctacatttcccctggattcggcctcggtcttgttatctctggagccatccgtgtccacgaggacatgcttcttgccgcctcggaaccactagctgctcaggccacacaggagaact

SEQ ID NO: 6111 - DNA, 306 bp, Zea mays
  Clone ID: 700355825H1
gaaggagagggatgcacaccacttgcgtgcgctgcttcctcctgcagttgttcctcaagaactcccgattaagaagatcatgcacaacctgcggcagtaccaggtccctttgcagcgctatatggccatgatggaccttcaggagaggaacgagaggcttttctacaagcttttaattgataacgtggaggagctgcttcctgtggtttatacaccaactgtaggtgaggcctgccagaagtatgggtccatctttcgacaaccacagggtctgtatgtcagcttgagggacaaggggaaggtcct

SEQ ID NO: 6112 - DNA, 257 bp, Zea mays
  Clone ID: 700171967H1
gtcggctccaattgaagagtgccgcaagaagatttggttggtggactcaaagggtttgattgttgactctcgtaaaaactccgttcagtcattcaaaaaaccttgggcacatgagcatgaacccttgacaaccttgtacgatgctgttcagtccatcaaacctacatttctgattgggacgtctggagttggaagaacattcacaaaagaagttgttgaggccatggcttccttcaatgagaggcctatcatctttt

SEQ ID NO: 6113 - DNA, 256 bp, Zea mays
  Clone ID: 700239492H1
aaaacagacgtcggctccaattgaagagtgccgcaagaagatttggttggtggactcaaagggtttgattgttgactctcgtaaaaactccgttcagtcattcaaaaaaccttgggcacatgagcatgagcccttgacaaccttgtacgatgctgttcagtccatcaaacctacagttctgattgggacgtctggagttggaagaacattcacaaaagaagttgttgaggccatggcttccttcaatgagaggcct

SEQ ID NO: 6114 - DNA, 277 bp, Zea mays
  Clone ID: 701160628H1
gtccacgaggacatgcttcttgccgcctcggaagcactagctgctcaggccacacaggagaacttcgacaagggatcaatcttcccgcccttcactaacattagaaagatctctgcgcgcattgccgcagccgtggctgcaaaagcttatgaactcggtttggcgacccgtctgcctcccccaagggacctggtgaaatatgcacagagctgcatgtacactcctgtctaccgtaactaccgatagtgctgctgggatcaattctgcagtaataaaa

SEQ ID NO: 6115 - DNA, 250 bp, Zea mays
  Clone ID: 700020733H1
ttggttggtggactcaaagggtttgattgttgactctcgtaaaaactccgttcagtcattcaaaaaaccttgggcacatgagcatgagcccttgacaaccttgtacgatgctgttcagtccatcaaacctacagttctgattgggacgtctggagttggaagaacattcacaaaagaagttgttgaggccatggcttccttcaatgagaggcctatcatcttttcactgtcaaatccaacctctcattct

SEQ ID NO: 6116 - DNA, 349 bp, Zea mays
  Clone ID: 700575032H1
tgcataaacgtgcaactggcgaggagtatcatgagcttatggaagagttcatggctgctgttaagcaaatctatggcgagaaagtcctcattcagtttgaggacttcgcgaatcataatgctcttaatctgcttgcaaaatatagcaagagccatcttgtgttcaatgatgacatccagggcacagcatcagtggtccttgcaggtttgttagcggcactcaaggtggttggtgggaccttggcagagcacacttatttattccttggtgctggggaggctggaactggtattgcagaactcattgctcttgagattcataacagacgtcggctccaatcgaagagtgc

SEQ ID NO: 6117 - DNA, 278 bp, Zea mays
  Clone ID: 700241204H1
ggacgctggtcacagcatcagtggtccttgcaggtttgttagcggcactcaaggtagctggtgggaccttggcagagcacacttatttattccttggtgctggggatgctggaactggtattgcagaactcattgctcttgagatttcaaaacagacgtcggctccaattgaagagtgccgcaagaagatttggttggtggactcaacaggtttgattggtgactctcgtaaaaactccgttcagtcattcaaaaaaccttgggcacatgagcatgag

SEQ ID NO: 6118 - DNA, 268 bp, Zea mays
  Clone ID: 700447091H1
caaaacagacgtcggctccaattgaagagtgccgcaagaagatttggttggtggactcaaagggtttgattgttgactctcgtaaaaactccgttcagtcattcaaaaaaccttgggcacatgagcatgagcccttgacaaccttgtacgatgctgttcagtccatcaaacctacagttctgattgggacgtctggagttggaagaacattcacaaaagaagttgttgaggccatggcttccttcaatgagaggcctatgacttttca

SEQ ID NO: 6119 - DNA, 274 bp, Zea mays
  Clone ID: 700469827H1
ctgctcttggaggagttcgtccatcagcttgtttgcctatcacaatcgatgttggcacaaataatgagaaactgcttaatgatgagttttacattggactccggcaaaaacgtgcaactggcgaggagtatcatgagcttatggaagagttcatggctgctgttaagcaaatctacggcgagaaagtcctcattcagtttgaggacttcgcgaatcataatgcttttactttgcttgcaaaatatagcaagagccatcttgttttcaatgatga

SEQ ID NO: 6120 - DNA, 248 bp, Zea mays
  Clone ID: 700043868H1
gagcgaaagaataacaaacattggtacccaagattgtttgctttcacaacgttacaacatatatatatcatatatgcatggacaggtacaatgcctctccagcagcaccagcaacaagggtggttagcagcagggactataaacaacagagtaccatccgcgttgatagattttttattactgcaaaattgatccccgcagcactaccggtagttgcggtagacgggagtgtacatgcagttctctgc

SEQ ID NO: 6121 - DNA, 248 bp, Zea mays
  Clone ID: 700167416H1
ggctgctgttaagcaaatctatggcgagaaagtcctcattcagtttgaggacttcgcgaatcataatgcttttaatttgcttgcaaaatatagcaagagccatcttgttttcaatgatgacatccagggcacagcatcagtggtccttgcaggtttgttagcggcactcaaggtggttggtgggaccttggcagagcacacttatttattccttggtgctggggaggctggaactggtattgcagaac

SEQ ID NO: 6122 - DNA, 241 bp, Zea mays
  Clone ID: 700166313H1
cggacgcgtggggttttcaatgatgacatccagggcacagcatcagtggtccttgcaggtttgttagaggcactcaaggtggttggtgggaccttggcagagcacacttatttattccttggtgctggggaggctggaactggtattgcagaactcattgctcttgagatttcaaaacagacgtcggctccaattgaagagtgccgcaagaagatttggttggtggactcaaagggtttga

SEQ ID NO: 6123 - DNA, 261 bp, Zea mays
  Clone ID: 700477627H1
ctcgagccggggacgtctggagttggaagaacattcacaaaagaagttgttgaggccatggcttccttcaatgagaggcctatcatcttttcactgtcaaatccaacctctcattctgaatgtactgctgaagaagcatataactggactcagggtcgtgtaatatttgccagtggcagtccatttgaccctgtggagtacgatgggaaggtttttgtacctggacagtcgaacaacgcctacattttccctggatttggc

SEQ ID NO: 6124 - DNA, 247 bp, Zea mays
  Clone ID: 700043873H1
gagcgaaagaataacaaacattggtacccaagattgtttgctttcacaacgttacaacatatatatatcatatatgcatggacaggtacaatgcctctccagcagcaccagcaacaagggtggttagcagcagggactataaacaacagagtaccatccgcgttgatagattttttattactgcaaaattgatccccgcagcactaccggtagttgcggtagacgggagtgtacatgcagttctctg

SEQ ID NO: 6125 - DNA, 272 bp, Zea mays
  Clone ID: 700027363H1
tgtcctagaagttctaaggaactggccacataggaacattcaagttatctgtgttactgatggtgagcgaatcttgggacttggagatttgggttctcagggaatgggaattcctgtaggcaaacttgctctatacactgctcttggaggagttcgtccatcagcttgtttgcctatcacaatcgatgttggcaccaataatgagaaactgcttaatgatgagttttacattggactccggcaaaaacgtgcaacatggcgagagtatcatg

SEQ ID NO: 6126 - DNA, 325 bp, Zea mays
  Clone ID: 700569811H1
ctcggtcttgttatctctggagccatccgtgtccacgaggacatgcttcttgccgcctcggaagcactagctgctcaggccacacaggagaacttcgacaagggatcaatcttcccgcccttcaccaacattagaaagatctctgcgcgcattgccgcagccgtggctgcaaaagcttatgaactcggtttggcgacccgtctgcctcccccaagggacctggtgaaatatgcacagagctgcatgtacactcctgtctaccgtaactaccgatagtgctgctgggatcaattctgcagtaataaaatatgtcgacgcagatgat

SEQ ID NO: 6127 - DNA, 264 bp, Zea mays
  Clone ID: 700551661H1
agaagttctaaggaactggccacataggaacattcaagttatctgtgttactgatggtgagcgaatcttgggacttggagatttgggttctcagggaatgggaattcgtaggcaaacttgctctatacactgctcttggaggagttcgtccatcagcttgtttgcctatcacaatcgatgttggcacaaataatgagaaactgcttaatgatgagttttacattggactccggcaaaaacgtgcaactggcgaggagtatcatg

SEQ ID NO: 6128 - DNA, 204 bp, Zea mays
  unsure (1)...(204): unsure at all n locations
  Clone ID: 700613723H1
tcttgttttcaatgatgacatccagggcacagcatcagtggtccttgcaggtttgttagcagcactcaaggtggttggtgggaccttggcagagcacacttatttattccttggtgctggggaggctggaactggtattgcagaactcattgctcttgagatttcaaaacagacgtcggctccaattgaagangtccgcaagaa

SEQ ID NO: 6129 - DNA, 232 bp, Zea mays
  Clone ID: 700171193H1
ggagtacgatgggaaggtttttgtacctggacagtcgaacaacgcctacattttccctggatttggcctcggtcttgttatctctggagccatccgtgtccacgaggacatgcttcttgccgcctcggaagcactagctgctcaggccacacaggagaacttcgacaagggatcaatcttcccgcccttcaccaacattagaaagatctctgcgcgcattgccgcagccgtg

SEQ ID NO: 6130 - DNA, 231 bp, Zea mays
  Clone ID: 700164679H1
cgatgggaaggtttttgtacctggacagtcgaacaacgcctacattttccctggatttggcctcggtcttgttatctctggagccatccgtgtccacgaggacatgcttcttgccgcctcggaagcactagctgctcaggccacacaggagaacttcgacaagggatcaatcttcccgcccttcaccaacattagagagatctctgcgcgcattgccgcagccgtggctgc

SEQ ID NO: 6131 - DNA, 253 bp, Zea mays
  Clone ID: 700570921H1
ggtcttgttatctctggagccatccgtgtccacgaggacatgcttcttgccgcctcggaagcactagctgctcaggccacacaggagaacttcgacaagggatcaatcttcccgcccttcaccaacattagaaagatctctgcgcgcattgccgcagccgtggctgcaaaagcttatgaactcggtttggcacccgtctgcctcccccaagggacctggtgaaatatgcacagagctgcatgtacactcctgt

SEQ ID NO: 6132 - DNA, 241 bp, Zea mays
  Clone ID: 701160615H1
aaggaataaataagtgtgctctgccaaggtcccaccaaccaccttgagtgctgctaacaaacctgcaaggaccactgatgctgtgccctggatgtcatcattgaaaacaagatggctcttgctatattttgcaagcaaattaaaagcattatgattcgcgaagtcctcaaactgaatgaggactttctcgccgaaatttgcttaacacaggcattaactttttccataagctcatgatact

SEQ ID NO: 6133 - DNA, 224 bp, Zea mays
  Clone ID: 700154717H1
gttctcagggaatgggaattcctgtaggcaaacttgctctatacactgctcttggaggagttcgtccatcagcttgtttgcctatcacaatcgatgttggcacaaataatgagaaactgcttaatgatgagttttacattggactccggcaaaaacgtgcaactggcgaggagtatcatgagcttatggaagagttcatggctgctgttaacaaatctacggcg

SEQ ID NO: 6134 - DNA, 289 bp, Zea mays
  Clone ID: 700475530H1
tgggaccttggcagagcacacttatttattccttggtgctggggaggctggaactggtattgcagaactcattgctcttgagatttcaaaacagacgtcggctccaattgaagagtgccgcaagaagaattggttggtggactcaaagggtttgattgttgactctcgtaaaaactccgttcagtcattcaaaaaaccttgggcacatgagcattgagccctggacaacttggtacgatgcggtcaagtcaatcaaacctacagtcctgattgggacgtctgaagttgg

SEQ ID NO: 6135 - DNA, 231 bp, Zea mays
  unsure (1)...(231): unsure at all n locations
  Clone ID: 700203726H1
cgaatcttgggacttggagatttgggttctcagggaatgggaattcctgtaggcaaacttgctctatacactgctcttggaggagttcgtccatcagcttgtttgcctatcacaatcgatgttggcacgaataatgagaaactgcttaatgatgagttttacattggactccggcaanaacgtgcaactggcgatgagtatcatgagcttatggaagagctcatggctgct

SEQ ID NO: 6136 - DNA, 193 bp, Zea mays
  Clone ID: 700241493H1
gaggcctatcatcttttcactgtcaaatccaacctctcattctgaatgtactgctgaagaagcatataactggactcagggtcgtgtaatatttgccagtggcagtccatttggccctgtggagtacgatgggaaggtttttgtacctggacagtcgaacaacgcctacattttccctggatttggcctcggt

SEQ ID NO: 6137 - DNA, 180 bp, Zea mays
  Clone ID: 700438637H1
ctcaaagggtttgattgttgactctcgtaaaggctcccttcagccattcaagaaacctggcgcgcatgagcacgagcccttgaaaccttgtatgatgctgttcagtccatcaaacctacagttctgatcgggacatctggagttggaagaacattcacaaaagaaatcattgaggccatg

SEQ ID NO: 6138 - DNA, 173 bp, Zea mays
  Clone ID: 700100702H1
cacaattgatgttggtacaaataacgagaaactgcttaatgatgagttctacattggactccggcaaaaacgtgcgactggcgaggagtatgatgagcttattgaagagttcatgtctgctgttaacaattctatggtgagaaagtcctcattcagtttgaggactttgccaa

SEQ ID NO: 6139 - DNA, 262 bp, Zea mays
  Clone ID: 700223081H1
cggacgcgtgggcggacgcgtgggcggacgcgtgggctcagggtcgtgcaatatttgccagtggcagtccatttgaccctgaggagtacgatgagaaggtttttgtacctggacagtcgaacaacgcctacattttccctggattcggcctcggtcttgttatctctggagccatccgtgtccacgaggacatgcttcttgccgcctcggaagcactagctgctcaggccacacaggagaacttcgacaagggatcaatctt

SEQ ID NO: 6140 - DNA, 295 bp, Zea mays
  unsure (1)...(295): unsure at all n locations
  Clone ID: 700099413H1
ggtacccaagattgtttgctttcacaacgttacaacatatatatatcatatatgcatggacaggtacaatgcctctccagcagcaccagcaacaagggtggttagcagcagggactataaacaacagagtaccatccgcgttgatagtagattttttattactgcaaaattgatccccgcagcactaccggtagttgcggtagaccggagtgtacatgcagttctctgcatatttcaccaggtcgctggggggangcagacgggtcgccagaccgagctcgtaggcttttgcagc

SEQ ID NO: 6141 - DNA, 347 bp, Zea mays
  Clone ID: 700613195H1
caacgcctacattttccctggattcggcctcggtcttgttatctctggagccatccgtgtccaagaggacatgcttcttgccgcctcggaagcactagctgctcaggccacacaggagaacttcgacaagggatcaatcttcccgcccttcaccaacattagaaagatctctgcgcgcattgccgcagccgtggctgcaaaagcttatgaactcggtttggcgacccgtctgcctcccccaagggacctggtgaaatatgcacagagctgcatgtacactcctgtctaccgtaactaccgatagtgctgctgggatcaattctgcagtaataaaatatgtcgacgca

SEQ ID NO: 6142 - DNA, 184 bp, Zea mays
  Clone ID: 700158857H1
ctgaatgtactgctgaagaagcatataactggactcagggtcgtgcaatatttgccagtggcagtccatttgaccctgtggagtacgatgggaaggtttttgtacctggacagtcgaacaacgcctacattttccctggattcggcctcggtcttgttatctctggagccatccgtgtccacga

SEQ ID NO: 6143 - DNA, 163 bp, Zea mays
  Clone ID: 700439831H1
tgggaattcctgtaggcaaacttgctctatacactgctctaggaggaggggacccatcagtttgcttgcctatcacaattgatgttggtacaaataacgagaaactgcttaatgatgagttctacattggactccggcaaaaacgtgcgactggcgaggatta

SEQ ID NO: 6144 - DNA, 224 bp, Zea mays
  Clone ID: 700017622H1
gcacgaggcattgccgcagccgtggctgcaaaagcttatgaactcggtttggcgacccgtctgcctcccccaagggacctggtgaaatatgcacagagctgcatgtacactcctgtctaccgtaactaccggtagtgctgctgggatcaattctgcagtaataaaatatgtcgacgcagatgatcctgcaatgttgtagtttattttttcatttgttggccctg

SEQ ID NO: 6145 - DNA, 154 bp, Zea mays
  Clone ID: 700224833H1
gcacaacctgcggcagtaccaggtccctttgcagcgctatatggccatgatggaccttcaggagaggaacgagaggcttttctacaagcttttaattgataacgtggaggagctgcttcctgtggtttatacaccaactgtaggtgaggcctgc

SEQ ID NO: 6146 - DNA, 254 bp, Zea mays
  Clone ID: 700099061H1
ggtcgctgaggggaggcagagaactgcatgtacactcccgtctaccgcaactaccggtagtgctgcggggatcaattttgcagtaataaaaaatctactatcaacgcggatggtactctgttgtttatagtccctgctgctaaccacccttgttgctggtgctgctggagaggcattgtacctgtccatgcatatatgatatatatatgttgtaacgttgtgaaagcaaacaatcttgggtaccaatgtttgtt

SEQ ID NO: 6147 - DNA, 221 bp, Zea mays
  Clone ID: 700577851H1
cgcaactaccggtagtgctgcggggatcaattttgcagtaataaaaaatctactatcaacgcggatggtactctgttgtttatagtccctgctgctaaccacccttgttgctggtgctgctggagaggcattgtacctgtccatgcatatatgatatatatatgttgtaacgttgtgaaagcaaacaatcttgggtaccaatgtttgttattctttcgctc

SEQ ID NO: 6148 - DNA, 228 bp, Zea mays
  Clone ID: 700100884H1
aatcgagcgaaagaataacaaacattggtacccaagattgtttgctttcacaacgttacaacatatatatatcatatatgcatggacaggtacaatgcctctccagcagcaccagcaacaagggtggttagcagcagggactataaacaacagagtaccatccgcgttgatagtagattttttattactgcaaaattgatccccgcagcactaccggtagttgcggta

SEQ ID NO: 6149 - DNA, 176 bp, Zea mays
  Clone ID: 700466638H1
tgctttcacggagaaggagagggatgcacaccacttgcgtgggctgcttcctcctgcagttgttcctcaagaactccaaattaagaagatcatgcacaacctgcggcagtaccaggtccctttgcagcgctatatggccatgatggaccttcaggagaggaacgagaggcttttct

SEQ ID NO: 6150 - DNA, 163 bp, Zea mays
  Clone ID: 700614366H1
tctgaatgtactgctgaagaagcatataactggactcagggtcgtgcaatatttgccagtggcagtccatttgaccctgtggagtacgatgggaaggtttttgtacctggacagtcgaacaacgcctacattttccctggattcggcctcggtctggtgatct

SEQ ID NO: 6151 - DNA, 275 bp, Zea mays
  unsure (1)...(275): unsure at all n locations
  Clone ID: 700084389H1
gacagggacgcccacagcgcgccaaatnttccagtatcatatatgcatagacaggtacagtgtctagcagccacaaaggtggtcagcagcagggccaacaaatgaaaaaataaactacaacattgcaggatcatctgcgtcgacatattttattactgcagaattgatcccagcagcactaccggtagttacggtagacaggantgtacatgcagctctgtgcatatttcaccaggtcccttgggggaggcagacgggtcgccaaaccgagttca

SEQ ID NO: 6152 - DNA, 145 bp, Zea mays
  Clone ID: 700090184H1
atcaacgcggatggtactctgttgtttatagtccctgctgctaaccacccttgttgctggtgctgctggagaggcattgtacctgtccatgcatatatgatatatatatgttgtaacgttgtgaaagcaaacaatcttgggtacc

SEQ ID NO: 6153 - DNA, 148 bp, Zea mays
  Clone ID: 700099462H1
ctatcaacgcggatggtactctgttgtttatagtccctgctgctaaccacccttgttgctggtgctgctggagaggcattgtacctgtccatgcatatatgatatatatatgttgtaacgttgaaaaaaaaaaaaaaaagggcggccg

SEQ ID NO: 6154 - DNA, 117 bp, Zea mays
  Clone ID: 700098372H1
gcgaggagtatgatgagcttattgaagagttcatgtctgctgttaagccattctatggtgagacagtcctcattcagtttgaggactttgccaatcataatgcctttgatttgcttg

SEQ ID NO: 6155 - DNA, 227 bp, Zea mays
  Clone ID: 700432379H1
cctcctaagataacgtacgtgcactcagaattccgctccagaagtaatacaaaatctatcaacgcggatggtactctgttgtttatagtccctgctgctaaccacccggggtgctggtgctgctggagaggcattgtacctgtccatgcatatatgatatatatatgttgtaacgttgtgaaagcaaacaatcttgggtaccaatgtttgttattctttcgctcgat

SEQ ID NO: 6156 - DNA, 307 bp, Zea mays
  Clone ID: 700101636H1
cggacgcgtgggcggacgcgtgggttctagatcgcgagcggccgccctttttttttttttttggtacccaagattgtttgctttcacaacgttacaacatatatatatcatatagtcatggacaggtacaatgcctctccagcagcaccagcaacaagggtggttagcagcagggactataaacaacagagtaccatccgcgttgatagtagattttttattactgcaaaattgatccccgcagcactaccggtagttgcggtagacgggagtgtacatgcagttctctgcatatttcaccaggtcg

SEQ ID NO: 6157 - DNA, 129 bp, Zea mays
  Clone ID: 700090392H1
cagggaatgggaattcctgtaggcaaacttgctctatacactgctcttggaggagttcgtccatcagcttgtttgcctatcacaatcgatgttggcacaaataatgagaaactgcttaatgatgagttt

SEQ ID NO: 6158 - DNA, 137 bp, Zea mays
  Clone ID: 700282016H1
agcttcttgccgcctcggaagcacgagctgctcaggccacacaggggaacttcgacaagggatcaatcttcccgcccttcaccaacattagaaagatctctgcgcgcattgccgcagccgtggctgcaaaagcttat

SEQ ID NO: 6159 - DNA, 105 bp, Zea mays
  Clone ID: 700042404H1
ctggaactggtattgcagaacttattgctcttgagatttcgaaacagacgaatgctccaattgaagagtgccgcaagaaggtttggctggtggactcaaagggtt

SEQ ID NO: 6160 - DNA, 124 bp, Zea mays
  Clone ID: 700465190H1
ctcaagaactccagattaagaagatcatgcacaacctgcggcagtaccaggtccctttgcagcgctatatggccatgatggaccttcaggagaggaacgagaggcttttctacaagctgttaat

SEQ ID NO: 6161 - DNA, 140 bp, Zea mays
  Clone ID: 700260024H1
cttttaatttgcttgcaaaatatagcaagagccatcttgttttcaatgatgacatccagggcacagcatcagtggtccttgcaggtttgttagcagcactcaaggtggttggtgggaccttggcagagcacacttattta

SEQ ID NO: 6162 - DNA, 103 bp, Zea mays
  Clone ID: 700579166H1
gaaaaatatagcaagagccatcttgttttcaatgatgatatccagggcacagcatcagtggtccttgcaggtttgttagcagcactcaagatggttcgtggga

SEQ ID NO: 6163 - DNA, 117 bp, Zea mays
  Clone ID: 700049441H1
gcttaatgatgagttttacattggactccggcaaaaacgtgcaactggcgaggagtatcatgagcttatggaagagttcatggctgctgttaagcaaatctacggcgagaaagtcct

SEQ ID NO: 6164 - DNA, 129 bp, Zea mays
  Clone ID: 700618285H1
accccggcgaggagtatcatgagcttatggaagagttcatggctgctgttaagccaatctacggcgagaaagtctcattcagtttgaggacttcgcgaatcatagtgcttttaatgtgcttgcaaaata

SEQ ID NO: 6165 - DNA, 115 bp, Zea mays
  Clone ID: 700259602H1
ctccaattgaagagtgccgcaagaagatttggttggtggaatcaaagggtttgattgttgactctcgtaaaaactccgttcagtcattcaaaaaaccttgggcacatgagcatga

SEQ ID NO: 6166 - DNA, 86 bp, Zea mays
  Clone ID: 700467465H1
agcgaatcttgggacttggagatttgggttctcagggaatgggaattcctgtaggcaaacttgctctatacactgctcttggagga

SEQ ID NO: 6167 - DNA, 270 bp, Zea mays
  unsure (1)...(270): unsure at all n locations
  Clone ID: 700215437H1
ggtgctcaaatctaaattgcattttatttctgcaattgatctcatgacagggacgcccacagcgcgccaaatgttccagtatcatatatgcatagacaggtacagtgtctagcagccacaaaggtggtcagcagcagggccaacaaatgaaaaaataaactacaacattgcaggatcatctgngtngacatattttatnacngcagaatngatcccagcagcactaccggtatttacggtagacnggagtgtacatgcagctctgggcat

SEQ ID NO: 6168 - DNA, 273 bp, Zea mays
  Clone ID: 700265281H1
gaaatatgcacagagctgcatgtacactcctgtctaccgtaactaccgatagtgctgctgggatcaattctgcagtaataaaatatgtcgacgcagatgatcctgcaatgttgtagtttattgtttcatttgttggccctgctgctgaccacctttgtggctggtagacactgtacttgtctgcatatatgatactggaacatttggcgcgctgtgggcgtccctgtcatgagatcaattgcagaaataaaatgcaatttagatttgagcacc

SEQ ID NO: 6169 - DNA, 297 bp, Zea mays
  Clone ID: 700083127H1
cccacgcgtccgctctgttttcttcttgtgttgcttttaatctggcacatgtttctaaattataataatgaatacttttttttggacaaaaaagtattcattattataatttagaaacctgtgccagattaaaagcacaaagcgaagctatagctcagcaaagcaaacccaaggacattgaggtgctgctctgctagcgtagtacgtgctacagcatgtcactcacgtcttccttcaatgagaggcctatcatcttttcactgtcaaatccaacctctcattctgaatgtactgctg

SEQ ID NO: 6170 - DNA, 290 bp, Zea mays
  Clone ID: 700336628H1
gcacggaatagcctacgttgccctccatgggctcctggcggcgctcaaggtggtcggcgggacacttgcggaccacacttacctgttcctcggcgccggcgatgccggaaccggcattgctgagctcatcgctctcgagatgtcgaaacatactgggtctccgatcgaagagtgccgcccgaagatctggctgatggactccaagggcctgatcgtagcgtcacggaaggactcgctgcaggcgttcaagaagccatgggcgcacgagcacgagcccgtggcgaccctgc

SEQ ID NO: 6171 - DNA, 195 bp, Zea mays
  Clone ID: 700017544H1
gcacgaggccgagctcattgctctcgagatgtccaaacatactgggtctccgatcgaagagtgccgcccgaagatctggctgatggactccaagggcctgatcgtggcgtcacggaaggactcgctgcaggcgttcaagaagccatgggcgcacgagcacgagcccgtggcgaccctgctggaggccgtgcagtc

SEQ ID NO: 6172 - DNA, 196 bp, Zea mays
  Clone ID: LIB148-042-Q1-E1-D11
acaacaagggcctggccttctcggaggcggagcgcgacgcgcactacctgcggggcctgctgccgcccgcgctggcgtcgcaggagctgcaggagaagaagctcatgcacaacctgcggcagtacgagcggccgttgcaccgctacatcgccatgatggacctgcaggagcgcaacgagaggctcttctacaagct

SEQ ID NO: 6173 - DNA, 152 bp, Zea mays
  Clone ID: LIB3060-012-Q1-K1-E8
gccagaagtatgggtccatctttggactaccacagggtctgtatgtcaggcgtgaaggacaaggtgaaggtcctagaagttctaaggaactggccacataggaacattcaagttatctgtgttactgatggtgagcgaatcttgttacttgt

SEQ ID NO: 6174 - DNA, 213 bp, Zea mays
  Clone ID: LIB3061-002-Q1-K1-H10
cggcaagaagattttgttggtggataaaaagggcttgattgttgactctcgggaagactcttttcaagcattcaaagccccttctagcacatgagcatgagcccttgacaaccttgtacgatgctgttcagtccatcaaacctacagttctgattgggacgtctggaattggaagaacattcacaaaagaagttgttgaagccatggcttcct

SEQ ID NO: 6175 - DNA, 293 bp, Zea mays
  Clone ID: LIB3066-008-Q1-K1-A2
cgcgcgcatcgccgccaaggtggccgccaaggcctacgagctcggcctcgccagccggcggccccgacccgacgacctcgtcagctacgcggagagctgcatgtacacccccacctaccgcagctaccggtaaggaccacccatgccgccatgcgtggcatggagccatggccggcgctagaggagtgagttttacacgtacgtactttgattttttttatgtactgtatttctgtgtacggcaaaatacaccacacccacatatatacggaggtgaagttgattcttctgac

SEQ ID NO: 6176 - DNA, 446 bp, Zea mays
  Clone ID: LIB3066-021-Q1-K1-B5
cccacgcgtccgcccacgcgtccgcggacgcgtggggatgtccaaacatactgggtctccgatcgaagagtgccgcccgaagatctggctgatggactccaagggcctgatcgtggtgtcacggaaggactcgctgcaggcgttcaagaagccatgggcgcacgagcacgagcccgtggcaaccctgctggaggccgtgcagtccctgaagccgacggtgctgatcggcacctcgggcaagggcggcaccttcaccaaggaggtggtggaggcgatggcgtcccagaacgagaagccggtcatcttcgcgctgtcgaacccgacctcgcactcggagtgcacggcggagcaggcctacacctggaccaagggccgcgcggtgttcgcgagctgcagccccttcgacagcggtgagctggacggcaaggtgctggtgctcgggcagt

SEQ ID NO: 6177 - DNA, 228 bp, Zea mays
  unsure (1)...(228): unsure at all n locations
  Clone ID: LIB3067-039-Q1-K1-C10
cggncncctnggangtcctagaagttctnaggaactngccacataggaacgttcaagnggnctgtgttacngatggngagccgaatcttnggacntngagatttnggttctcanggaatgggaantcccgtaggcaaacttnctctatncactgntcttggagganttcgtccatcaacttgtttnccnattacaaaacgatgttgtcncaaatnntnngaaaaacct

SEQ ID NO: 6178 - DNA, 127 bp, Zea mays
  Clone ID: LIB3078-007-Q1-K1-A1
gtgacatctggagttggaagaacattcacaaaagaaatcattgaggccatgtcttcctgtgacgagaggcctatcatcttttcactgtcaaacccaacctcgcattctgaatgcactgcttaacaag

SEQ ID NO: 6179 - DNA, 345 bp, Zea mays
  Clone ID: LIB3078-050-Q1-K1-G11
tcggcatcagaaagatctctgcgcacatcgctgcagccgtggctgcaaaagcctactagctcgggctgccgacccgtctgcctgccccaacgaccctgtgaaatatgccgaaaactggatgtacacttccgtctaccgaaactaccggtaatgctggcgggaatcaattttgccagtattaaaaaatctatcaacgcgggatggtactctgttgtttatagtccctgctgctaaccacccttgttgctggtgctgctggagaggcattgtacctgtccatgcatatatgatatatatatgttgtaacgttgtgaaagcaaacaatcttgggtaccaatgtttgtt

SEQ ID NO: 6180 - DNA, 226 bp, Zea mays
  Clone ID: LIB3078-035-Q1-K1-H5
accaaatcctcaatttaaagaatgccccaaggagggttgtgctggtgggactcaaaaggtttggattggtgggctctcgtaaagggctcccttcagccattcaagaaaccttgggcccatgagcacgagcccttgaaaaccttgtatgatgctgttcaatccatcaaacctacagttctgatcgggacatctggagttggaaggaacattcacaaaagaaatcatt

SEQ ID NO: 6181 - DNA, 408 bp, Zea mays
  Clone ID: LIB3060-024-Q1-K1-D9
tgctcattgacaacgtcgaggagttacttccaatcgtgtacactccaaccgttggcgaggcctgccaaaagtatggatccatatttagtcgccctcagggtctttatatcagtttgaaggagaagggaaagatccttgaggtgttgaagaactggccagagaggagcattcaggttatagttgttactgatggtgaacgtattttggggcttggagatctcggatgccaggggatggggattcctgttggtaaactttccctttacactgccctgggaggagttcgtccatctgcttgcttgccgatcacattggatgttggtacaaataacgaggagctgcttaatgacgaattttacattggcttgagacaaagaagagccactggccaggagtacactgattttc

SEQ ID NO: 6182 - DNA, 426 bp, Zea mays
  Clone ID: LIB3078-022-Q1-K1-D10
cagacttatttgttccttggtgctggggatgctggaactggtattgcagaacttattgcgcttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctggtcactccatcaaacctacagttctgatcggtacatctggagttggaagaacattcacaaaagaaatcattgaggccatgtcttccttcaacgagaggcctatcatcttttcactgtcaaacccaacctcgcattctgaatgcactgctgaacaagcatatacctggagtcagggccgttcaatctttgccagtggcagt

SEQ ID NO: 6183 - DNA, 445 bp, Zea mays
  Clone ID: LIB3060-021-Q1-K1-G10
gttctacattggactccggcaaaaacgtgcgactggcgaggagtatgatgagcttattgaagagttcatgtctgctgttaagcaattctatggtgagaaagtcctcattcagtttgaggactttgccaatcataatgcctttgatttgcttgaaaaatatagcatgagccatcttgttttcaatgatgatatccagggcacagcatcagtggtccttgcaggtttgttagcagcactcaagatggttggtgggaccctggcagagcagacttatttgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaa

SEQ ID NO: 6184 - DNA, 496 bp, Zea mays
  unsure (1)...(496): unsure at all n locations
  Clone ID: LIB189-006-Q1-E1-D2
tgggtccggcaactgtaacgctggtcagtaggcgtctagaattcaagggccgaccgacccgtccaaacccaaactcgcattctgaatgcactgctgaacaagcatatacatggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggacatgcttctcgccgcatcgaaagcgctagctgatcaggccacacaggacaacttcgagaagggctccatcttcccacccttcaccagcatcagaaagatctctgcgcacatcgctgcagccgtggctgcaaaagcctacgagctcggtctggcgacccgtctgcctcnccccagcgacctggtgaaatatgcagagaactgcatgtacactcccgtctaccgcaacta

SEQ ID NO: 6185 - DNA, 410 bp, Zea mays
  Clone ID: LIB189-010-Q1-E1-C4
atagcagcactcaagatggttggtgggaccctggcagagcagacttatttgttccttggtgctggggaagctggaactggtattgcagaacttattgctcttgagatttcgaaacagacgaatgctccaattgaagagtgccgcaagaaggtttggctggtggactcaaagggtttgattgttgactctcgtaaaggctctcttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcac

SEQ ID NO: 6186 - DNA, 496 bp, Zea mays
  unsure (1)...(496): unsure at all n locations
  Clone ID: LIB189-029-Q1-E1-A5
aggcatccagcagctttccagcanaancnnncaaaantannggncnnngncnnnnnnnnantccaaggacgcgtgggtcaagatggttggtgggaccctggcagagcagacgtatttgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgctgaacaagcatataca

SEQ ID NO: 6187 - DNA, 420 bp, Zea mays
  Clone ID: LIB36-021-Q1-E1-D12
atggtggactcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcattgtcaaacccaacctcgcattctgaatgcactgctgaacaagcatatacctggagtcagggccgttcgatctttgccagtggcagtccatttgcccccgtggagtacgaaggaaagatttttgtgcctgggcagtcgaacaatgcctacattttccctggactcggcctcggtcttgtgatctctggggccgtccgt

SEQ ID NO: 6188 - DNA, 415 bp, Zea mays
  Clone ID: LIB36-003-Q1-E1-B4
acaacctcgcattctgaatgcactgctgaacaagcatatacctggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggacatgcttctcgccgcctcgaaagcgctagctgatcaggccacacaggacaacttcgagaagggctccatcttcccacccttcaccagcatcagaaagatctctgcgcacatcgctgcagccgtggctgcaaaagcctacgagctcggtctggcgacccgtctgcctccccccagcgacctggtgaaatatgcagagaactgcatgtacactcccg

SEQ ID NO: 6189 - DNA, 429 bp, Zea mays
  Clone ID: LIB36-017-Q1-E1-D7
acatatacctggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggacatgcttctcgccgcctcgaaagcgctagctgatcaggccacacaggacaacttcgagaagggctccatcttcccacccttcaccagcatcagaaagatctctgcgcacatcgctgcagccgtggctgcaaaagcccacgagctcggtctggcgacccgtctgcctccccccagcgacctggtgaaatatgcagagaactgcatgtacactcacgtctaccgcaactaccggtagtgctgcggggatcaattttgcagtaat

SEQ ID NO: 6190 - DNA, 393 bp, Zea mays
  Clone ID: LIB189-018-Q1-E1-D11
ggacaaggggaaggtcctagaagttctaaggaactggccacataggaacattcaagttatctgtgttactgatggtgagcgaatcttgggacttggagatttgggttgtcagggaatgggaattcctgtaggcaaacttgctctatacactgctctaggaggagttgacccatcagtttgcttgcctatcacaattgatgttggtacaaataacgagaaactgcttaatgatgagttctacattggactccggcaaaaacgtgcgactggcgaggagtatgatgagcttattgaagagttcatgtctgctgttaagcaattctatggtgagaaagtcctcattcagtttgaggactttgccaatcacaatgcctttgatttgcttgaaaaata

SEQ ID NO: 6191 - DNA, 418 bp, Zea mays
  Clone ID: LIB189-014-Q1-E1-D11
accacgcgtccgcccacgcgtccggcagagcagacgtatttgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgctgaacaagcatata

SEQ ID NO: 6192 - DNA, 368 bp, Zea mays
  Clone ID: LIB3078-049-Q1-K1-G10
catcagtttgcttgcctatcacaattgatgttggtacaaataacgagaaactgcttaatgatgagttctacattggactccggcaaaaacgtgcgactggcgaggagtatgatgagcttattgaagagttcatgtctgctgttaagcaattctatggtgagaaagtcctcattcagtttgaggactttgccaatcataatgcctttgatttgcttgaaaaatatagcaagagccatcttgttttcaatgatgatatccagggcacagcatcagtggtccttgcaggtttgttagcagcactcaagatggttggtgggaccctggcagagcagacttatttgttccttggtgcttgggaggctggaact

SEQ ID NO: 6193 - DNA, 446 bp, Zea mays
  Clone ID: LIB3078-012-Q1-K1-E8
gcagacttatttgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctctcttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgcttaacaagcatatacatggagtcaaggccgttcaatctttgtcagtggcagtccatttgcccccgtggagt

SEQ ID NO: 6194 - DNA, 433 bp, Zea mays
  Clone ID: LIB36-018-Q1-E1-B9
tgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgctgaacaagcatatacctggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggacatgcttctcgccgcctcgaaagcgctagctgatcaggccacacaggaaaacttcgagaagggctccatctttccaaccttcatcagcat

SEQ ID NO: 6195 - DNA, 427 bp, Zea mays
  Clone ID: LIB36-012-Q1-E1-H9
cacacgcgtccgcccacgcgtccgcccacgcgtccgctcttggaggagttgacccatcagtttgcttgcctatcacaattgatgttggtacaaataacgagaaactgcttaatgatgagttctacattggactccggcaaaaacgtgcgactggcgaggagtatgatgagcttattgaagagttcatgtctgctgttaagcaattctatggtgagaaagtcctcattcagtttgaggactttgccaatcataatgcctttgatttgcttgaaaaatatagcaagagccatcttgttttcaatgatgatatccagggcacagcatcagtggtccttgcaggtttgttagcagcactcaagatggttggtgggaccctggcagagcagacttatttgttccttggtgctggggaagctggaactggtat

SEQ ID NO: 6196 - DNA, 414 bp, Zea mays
  unsure (1)...(414): unsure at all n locations
  Clone ID: LIB189-027-Q1-E1-C5
agcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgctgaacaagcatatacatggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggaaatgcntcttcgcggcttcaaaaccgctacctgatcaggccacacaggacaac

SEQ ID NO: 6197 - DNA, 479 bp, Zea mays
  unsure (1)...(479): unsure at all n locations
  Clone ID: LIB84-005-Q1-E1-A11
tttgcaactgtcgtacgcatgtccgtacctgtccacgaccccnggccgtcnnantcagttagaggactttgccaatcacaatgcctttgatttgcttgaaaaatatagcaagagccatcttgttttcaatgatgatatccagggcacagcatcagtggtccttgcaggtttgttagcagcactcaagatggttggtgggaccctggcagagcagacgtatttgttccttggtgctggggaagctggaactggtattgcagaacttattgctcttgagatttcgaaacagacgaatgctccaattgaagagtgccgcaagaaggtttggctggtggactcaaaaggtttgattgttgactctcgtaaaggctcccttcagccattcaagaaaccttgggcgcatgagcacgagcccttgaaaaccttgtatgatgctgttcagtccatcaaacctacagttctgatcgggacatctggag

SEQ ID NO: 6198 - DNA, 347 bp, Zea mays
  Clone ID: LIB189-018-Q1-E1-G7
agggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgctgaa

SEQ ID NO: 6199 - DNA, 430 bp, Zea mays
  unsure (1)...(430): unsure at all n locations
  Clone ID: LIB3079-004-Q1-K1-A10
ctggcgaggagtatcatgagcttatgtgttagagttcatggctgctgttaagcagaatctgacggcgagaaagtcctcattcagtttgaggacttcgcgaatcataatgcttttaatttgcttgcaaaatatagcaagagccatcttgttttcaatgatgacatccagggcacagcatcagtggtccttgcaggtttgttagcagcactcaaggtggttggtgggaccttggcagagcacacttatttattccttggtgctggggaggctggaactggtattgcagaactcattgctcttgagatttcaaaacagacgtcggctccaattgaagagtgccgcaagaagatttggttggtggactcaaagggtttgattgttgactctcgtaaaaactccngtcagtcattcaaaaaaccttgggcacatg

SEQ ID NO: 6200 - DNA, 373 bp, Zea mays
  unsure (1)...(373): unsure at all n locations
  Clone ID: LIB189-028-Q1-E1-F11
atcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcactgtcaaacccaacctcgcattctgaatgcactgctgaacaagcatatacctggagtcagggccgttcaatctttgccagtggcagtccatttgcccccgtggagtacgaaggaaagacttttgtgcctgngcagtcgaacaatgcctacattttccct

SEQ ID NO: 6201 - DNA, 353 bp, Zea mays
  Clone ID: LIB84-029-Q1-E1-A6
acccacgcgtccgccagggcacagcatcagtggtccttgcaggtttgttagcagcactcaagatggttggtgggaccctggcagagcagacttatttgttccttggtgctggggaggctggaactggtattgcagaacttattgctcttgagatttcgaaacagacgaatgctccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctgga

SEQ ID NO: 6202 - DNA, 346 bp, Zea mays
  Clone ID: LIB3060-002-Q1-K2-A8
ccaaattaagaagttcatgaacaccctgcggcagtaccagacccctttgcagcggtatatagctatgatgaaccgtcaggaaacggacgagaggcttttctacaagcttttaattgataatgtggtggagctgcttccttttgtttacacaccaactgtaggtgaggcctgccagaagtatgggtccatctttggacgaccacagggtctgtatgtcagcctgaaggacaaggggaaggtcctagaagttctaaggaactggccacataggaacattcaagttatctgtgttactgatggtgagcgaatcttgggacttggaaacctgggttggcaaggaatggga

SEQ ID NO: 6203 - DNA, 451 bp, Zea mays
  Clone ID: LIB3067-049-Q1-K1-F5
caacctctcattctgaatgtactgctgaagaagcatataactggactcagggtcgtgtgatatttgccagtggcagtccatttgaccctgtggagtacgatgggaaggtttttgtacctggacagtcgaacaacgcctacattttccctggatttggcctcggtcttgttatctctggagccatccgtgtccacgaggacatgcttcttgccgcctcggaagcactagctgctcaggccacacaggagaacttcgacaagggatcaatcttcccgcccttcaccaacattagaaagatctctgcgcgcattgccgcagccgtggctgcaaaagcttatgaactcggtttggcgacccgtctgcctcccccaagggacctggtgaaatatgcacagagctgcatgtacactcctgtctaccgtaactaccggtagtgctgctgggatcaatt

SEQ ID NO: 6204 - DNA, 409 bp, Zea mays
  unsure (1)...(409): unsure at all n locations
  Clone ID: LIB3062-026-Q1-K1-C8
ggagaaggagagggatgcacaccacttgcgggggctgcttcctcctgcagttgtgcctcaagaactccaaattaagaagatcatgcacaacctgcggcagtaccaggtccctttgcagcgctatatggccatgatggaccttcaggagaggaacgagaggcttttctacaagcttttaattgataacgtggaggagctgcttcctgtggtttatacaccaactgtaggtgaggcctgccagaagtatgggtccatctttcgacaaccacagggtctgtatgtcagcttgagggacaaggggaaggtcctagaagttctaaggaactggccacataggaacattcaagttatctgtgttactgatggtgagcgaatcttgggactnggagatttgggttcttagggaatg

SEQ ID NO: 6205 - DNA, 429 bp, Zea mays
  Clone ID: LIB3059-011-Q1-K1-C4
gcgggctcatggtcgtgtaatatttgccagtggcagtccatttgaccctgtggagtacgaggggaaggttgttgtacctggacagtcgaacaacgcctacattttccctggatttggcctcggtcttgttatctctggagccatccgtgtccacgaggacatgcttcttgccgcctcggaagcactagctgctcaagccacacaggagaacttcgacaagggatcaatcttcccgcccttcaccaacattagaaagatctctgcgcgcattgccgcagccgtggctgcaaaagcttatgaactcggtttggcgacccgtctgccttccccaaaggacctggtgaaatatgcacagagctgcatgtacactcctgtctaccgtaactaccggtagtgctgctgggatcaattctgcagtaataaaatatg

SEQ ID NO: 6206 - DNA, 368 bp, Zea mays
  Clone ID: LIB3061-002-Q1-K2-H10
ccgcaagaagatttggttggtggactcaaagggtttgattgttgactctcgtaaaaacgccgttcagtcattcaaaaaaccttgggcacatgagcatgagcccttgacaaccttgtacgatgctgttcagtccatcaaacctacagttctgattgggacgtctggagttggaagaacattcacaaaagaagttgttgaggccatggcttccttcaatgagaggcctatcatcttttcactgtcaaatccaacctctcattctgaatgtactgctgaagaagcatataactggactcagggtcgtgcaatatttgccagtggcagtccatttgaccctgtggagtaccaagggaaagtttttggacctg

SEQ ID NO: 6207 - DNA, 378 bp, Zea mays
  Clone ID: LIB3060-008-Q1-K1-H3
ggagcgaaagtattaacaaacattggtacccaagattgttcgctttcacaacgttacaacatatatatcatatatgcatggacaggtacaatgcctctccagcagcaccagcaacaagggtggttagcagcagggactataaacaacagagtaccatccgcgttgatagatctttattactgcaaaattgatccccgcagcactaccggtagttgcggtagacgggagtgtacatgcagttctctgcatatttcaccaggtcgctggggggaggcagacgggtcgccagaccgagctcgtaggcttttgcagccacggctgcagcgatgtgcgcagagatctttatgatgctggtgaagggtgggaagatggaaccct

SEQ ID NO: 6208 - DNA, 417 bp, Zea mays
  unsure (1)...(417): unsure at all n locations
  Clone ID: LIB3060-020-Q1-K1-E10
agttgagtcacgagagtttgtgtatagataaaagantagaatgcacgactttcagatctcgggccaaattaacaagttcatgaacaccctgcggcagtaccagacccctttgcagcggtatatagctatgatgaaccttcaggaaacggacgagaggcttttctacaagcttttaattgataatgtggtggagctgcttccttttgtttacacaccaactgtaggtgaggcctgccagaagtatgggtccatctttggacgaccacagggtctgtatgtcagcctgaaggacaaggggaaggtcctagaagttctaaggaactggccacataggaacattcaagttatctgtgttactgatggtgaacgaatcttgggacttggagactttgggtgtcagggaatgggaaattctgt

SEQ ID NO: 6209 - DNA, 407 bp, Zea mays
  unsure (1)...(407): unsure at all n locations
  Clone ID: LIB189-032-Q1-E1-E7
gttctagatcgcgagcggccgccctttttttttttttttttttttggagcgaaagaataacaaacattggtacccaagattgtttgctttcacaacgttacaacatatatatcatatatgcatggacaggtacaatgcctctccagcagcaccagcaacaagggtggttagcagcagggactataaacaacagagtaccatccgcgttgatagatttttattactgcaaaattgatccccgcagcactaccggtagttgcggtagacgggagtgtacatgcagttctctgcatatttcaccaggtcgctggggggaggcagacgggtcgccagaccgagctcgtaggcttttgcagccacggctgcancgatgtgcgcaaagatctttctgatgctggtgaagggtg

SEQ ID NO: 6210 - DNA, 422 bp, Zea mays
  Clone ID: LIB36-019-Q1-E1-F11
atcgtcatcagccagcacaggactaggtatcgtgggtcgacccaagcgtctacacaaacgttctgaaacatttcactgtcaaacccaacctcgcattctgaatgcactgctgaacaagcatatacctggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggacatgcttctcgccgcctcgaaagcgctagctgatcaggccacacaggacaacttcgagaagggctccatcttcccacccttcaccagcatcagaaagatctctgcgcacatcgctgcagccgtggctgcaaaagccta

SEQ ID NO: 6211 - DNA, 351 bp, Zea mays
  Clone ID: LIB3062-038-Q1-K1-D1
acggtggaggctggaactggtattgcagaactcattgctcttgagatttcaaaacagacgtcgggtccgattgaagagtgccgcaagaagatttggttggtggactcaaagggtttgattgttgactctcgtaaaaactccgttcagtcattcaaaaaaccttgggcacatgagcatgagcccttgacaaccttgtacgatgctgttcagtccatcaaacctacagttctgattgggacgtctggagttggaagaacattcacaaaagaagttgttgaggccatggcttccttcaatgagaggcctatcatcttttcactgtcaaatccaacctttcattctgaatgtact

SEQ ID NO: 6212 - DNA, 364 bp, Zea mays
  unsure (1)...(364): unsure at all n locations
  Clone ID: LIB189-029-Q1-E1-A4
accacacgtccgcggacgcgtgggatctggagttggaagaacattcacanaagaaatcattgaggccatgtcttccttcaacgagaggcctatcatcttttcactgtcaaacccaacctcgcattctgaatgcactgctgaacaagcatatacctggagtcagggccgttcaatctttgccagtggcagtccatttgcccccgtggagtacgaaggaaagacttttgtgcctgggcagtcgaacaatgcctacattttccctggactcggcctcggtcttgtgatctctggagccgtccgtgtccacgaggacatgcttctcgccgcctcgaaagcgctagctgatcaggccacacaggacaac

SEQ ID NO: 6213 - DNA, 451 bp, Zea mays
  Clone ID: LIB36-022-Q1-E1-F12
actgttatactgcacgcacaggtccgagactcgcgggtcgacgcaagcgtctggaaacagtcgaatgatccaattgaagagtgccgcaagaaggtttggctggtggactcaaagggtttgattgttgactctcgtaaaggctcccttcagccattcaagaaaccttgggcgcatgagcacgagcccttgaaaaccttgtatgatgctgttcagtccatcaaacctacagttctgatcgggacatctggagttggaagaacattcacaaaagaaatcattgaggccatgtcttccttcaacgagaggcctatcatcttttcattgtcaaacccaacctcgcattctgaatgcactgctgaacaagcatatacctggagtcagggccgttcgatcgttgccagttgcagttcattttccccccttggagttacgaaaggaaagactttttgtg

SEQ ID NO: 6214 - DNA, 353 bp, Zea mays
  Clone ID: LIB3079-001-Q1-K1-H3
gactagttctaggtacgatgctgttcagtccatcaaacctacagttctgattgggacgtctggagttggaagaacattcacaaaagaagttgttgaggccatggcttccttcaatgagaggcctatcatcttttcactgtcaaatccaacctctcattctgaatgtactgctgaagaagcatataactggactcagggtcgtgtaatatttgccagtggcagtccatttgaccctgtggagtacgatgggaaggtttttgtacctggacagtcgaacaacgcctacattttccctggatttggcctcggtcttgttatctctggagccatccgtgtccacgaggacatgcttc

SEQ ID NO: 6215 - DNA, 409 bp, Zea mays
  unsure (1)...(409): unsure at all n locations
  Clone ID: LIB189-014-Q1-E1-D12
agccncttaacgtctgcttcaccgatacgtaccagtcccacatgtccgggtccacccacgagtccgaacacgcgtccgcccatgcgtccggcagagcacacgtatttgttccttggtgctggggaggctggaactggtagtgcagaacttattgctcttgacatttcgaaacagacgagtgctccaattgaagagtgccgcaaaaaggtttggctggtggactcaaagggtttgattgttgactctcgtaaaggctcccttcaatcattcaagaaaccttgggcgcatgagcacaagcccttgaaaaccttgtatgatgctgttcagtccatcacacgtacagttctgatcgggacatctggagttggaagaacattcacaaaagaaatcattgagggcatgtcttcct

SEQ ID NO: 6216 - DNA, 295 bp, Zea mays
  Clone ID: LIB189-026-Q1-E1-C1
ttagcctgcagtgcggtctagaattacacggccgagccacgcgtccacggacacgtgggcggacgcgtgggttcgagaagggctccatcttcccacccttcaccagcatcagaaagatctctgcgcacatcgctgcagccgtggctgcaaaagcctacgagctcggtctggcgacccgtctgcctccccccagcgacctggtgaaatatgcagagaactgcatgtacactcccgtctaccgcaactaccggtaatgctgccgggatcaattttgccgtaataaaaaatctatcaa

SEQ ID NO: 6217 - DNA, 423 bp, Zea mays
  Clone ID: LIB3079-001-Q1-K1-H5
tgggagtgatgctacgtactagtcgactgtcgtaccggtgctgaattattggctggacgaaccactcctgcctagttctaggtacgatgctgatcagtccatcaaacctacagttatgaattgggacgtctggagttaggaagaacattcacaaaagaagttggtgaggccatggctttcttcaatgagaggcctatcatctttttactgtcaaatccaacctctcattctgaatgtactgctgaagaagcatataactggactcagggtcgtgtaatatttggccagtggcagtccatttgaccctgtggagtacgatgggaaggtttttgtacctggacagtcgaacaacgcctacattttccctggatttggccttggtcttgttatctctggagccatacgtgtccacgaggacatgct

SEQ ID NO: 6218 - DNA, 255 bp, Zea mays
  Clone ID: LIB36-008-Q1-E1-C5
ggaaaaatatgcagagaactgcatgtacactcccgtctaccgcaactaccggtagtgctgcggggatcaattttgcagtaataaaaatctatcaacgcggatggtactctgttgtttatagtccctgctgctaaccacccttgttgctggtgctgctggagaggcattgtacctgtccatgcatatatgatatatatgttgtaacgttgtgaaagcaaacaatcttgggtaccaatgtttgttattctttcgctc

SEQ ID NO: 6219 - DNA, 269 bp, Zea mays
  Clone ID: LIB83-015-Q1-E1-G7
gcagagaactgcatgtacactcccgtctaccgcaaccaccggtagtgctgcggggatcaactttgcagtaataagacatctactatcaacgcggatggtactctgttgtttatagtccctgctgctaaccacccttgttgctggtgctgctggagaggcattgtacctgtccatgcatatatgatatatatacgttgtaacgttgtgaaagcagacaatcttgggtaccaatgtttgttactctttcgctcgatgaagatcctgtaaca

SEQ ID NO: 6220 - DNA, 198 bp, Zea mays
  Clone ID: LIB3062-024-Q1-K1-D2
ggagaaggagagggatgcacaccacttgcgggggctgcttcctcctgcagttgtgcctcaagaactccaaattaagaagatcatgcacaacctgcggcagtaccaggtccctttgcagcgctatatggccatgatggaccttcaggagaagaacgagaggcttttctacaagcttttaattgataacgtggaagaact

SEQ ID NO: 6221 - DNA, 290 bp, Zea mays
  unsure (1)...(290): unsure at all n locations
  Clone ID: LIB3062-026-Q1-K1-C4
agaagccagcgtctggncctaacccccgctaacgtacgacaatccggtatggatcccgggcagaaggagaggggtgcacaccacttgctggggctgctttctgcttcagatgtgcctcaagaactccaaagtaaggagatcatgcacaacctgcggcagtaccagctacctttgcagcgctatatggccatgatggaccttcacgagaggaacgaaaggctgttctacaagctgctaattgataacatgcaggagctgcttcctgcgggttatacaccaactgtaggtga

SEQ ID NO: 6222 - DNA, 247 bp, Zea mays
  Clone ID: LIB83-013-Q1-E1-E12
cacaactaccggtagtgctgcggggatcaattttgcagtaataaaaaatctactatcaacgcggatggtactctgttgtttatagtccctgctgctaaccacccttgttgctggtgctgctggagaggcattgtacctgtccatgcatatatgatatatatatgttgtaacgttgtgaaagcacacaatcttgggtaccaaaaaaaaatcatttaagatcaatattgacaaaataaccgtgcgagag

SEQ ID NO: 6223 - DNA, 322 bp, Zea mays
  Clone ID: LIB83-002-Q1-E1-F4
agggactgcctgtactgacatactgtcgacgcatatactgagactagtaggacgacgcaagactctaaagtgagtcttattaaactctatcaacgcggatggtactctgttgtttatagtccctgctgctaaccacccttgttgctggtgctgctggagaggcattgtacctgtccatgcatatatgatatatatgttgtaacgttgtgaaagcaaacaatcttgggtaccaatgtttgttaaaaaaaaaaaaagaatcaacaagactaaaataaagacaactaaataaaaacagaataaccacgaagcagatacacatcat

SEQ ID NO: 6224 - DNA, 269 bp, Glycine max
  Clone ID: 700698057H1
cttgttttcaatgatgatatccaaggcaagaaagaaaaaccttgcaggtttgttagcagcactcaagatggttagtgggaccctggcagagatgacttatttgttccttggtgctggggaggctggaactggtattgcagaacttattgctcttgagatttcgaaacagacgaatgctccaattgaagagtgccgcaagttggtttggctggtggactcaaagggtttgattgttgatctcgtaaaggctcacttcagccattcaagaa

SEQ ID NO: 6225 - DNA, 265 bp, Glycine max
  unsure (1)...(265): unsure at all n locations
  Clone ID: 700744209H1
gcttcagatgattcttaatggagtggggcgagtgatagtgatgatagtagaagttataaattttcagaaagtgtacgataggtacgtgattctatacgagataggacaacaatgcttacattntcccgggctttggtcnngggntggtaatctcaggagcaatcagagtgcatgatgatatgctattagcgttnntgtggagccttggctaaactagtgtctaacgagaattacgaaaagggcttgatttatccaccattctcta

SEQ ID NO: 6226 - DNA, 202 bp, Glycine max
  unsure (1)...(202): unsure at all n locations
  Clone ID: 700979875H2
caacagtgttgattggaacatcgggacaaggaagaacttttactaaagaagngattgangcaatggctctattaacaagagacctattattcttctcttccaaccctacgtcacgncaaatgcatgtgaaaactacagtggagccgggactgcattttgcatgggatcattccctgtgatagaggaatgtttgcggcagcat

SEQ ID NO: 6227 - DNA, 277 bp, Glycine max
  Clone ID: 701013601H1
ctcgagccgctcgagccggaaaaagcgttcaactcgtttgagggtggtgagtatgaccccaagcagcagcatcagcagcaggtccggtgatagaaacggcagcgttgtgatggagacgccgttgaaagaattgaaaaaggaatccacggtggctgacgtggacgataacgccatctccgccggcggccctcaagatgtctacggcgaggatagggctacggaggatcactttgttaccccttggagtgtttctgttgccagtggttatacactattg

SEQ ID NO: 6228 - DNA, 260 bp, Glycine max
  Clone ID: 701054477H1
aagaagatctggctcgtggactcaaagggacttattgttagctctcgtttggaatcacttcagcagttcaaaaagccttgggcccatgagcatgaacctgttaagagtcttctggatgctgtcaaggcaatcaagccaaccgttttgattggatcatctggagcagggaagacatttactaaggaggtggttgaaaccatggcatccttgaatgagaaaccacttattcttgctctctccaacccaacttcacaatctga

SEQ ID NO: 6229 - DNA, 254 bp, Glycine max
  Clone ID: 701206630H1
gccaataatgcatacatattccctggatttggtctcggtttaataatgtctgggaccattcgagtgcatgatgacctgcttctggctgcctgtaagtgctcaagacacttgcgaacattaatttcaaacttatgtttgggacaggtgaaaataggatcatggtaggaatgaaatatacatttggaattaatacaatgtcatattatttgattttgatggaacagctgaggctttggctgcacaagtgagccaag

SEQ ID NO: 6230 - DNA, 330 bp, Glycine max
  Clone ID: 700653458H1
ggggaagattcttgaagtattgaaaaactggcctgagaaaagtattcaagttattgttgtaacagatggtgaacgaattttgggacttggggatcttggatgtcaggggatgggaattcctgttggtaaattggccttgtacacagcactaggaggagttagaccatcagcatgtttgcctattacgattgatgtggggacaaacaatgagaaattactaaatgatgagttttacattgggcttagacaaaagagggcaactgggcaggaatattctgaacttttgcacgagttcatgactgctgtcaagcaaaactacggagaaaaagt

SEQ ID NO: 6231 - DNA, 329 bp, Glycine max
  unsure (1)...(329): unsure at all n locations
  Clone ID: 700650905H1
ggggaagattcttgaagtattgaaaaactggcctgagaaaagtattcaagttattgttgtaacagatggtgaacgaattttgggacttggggatcttggatgtcaggggatgggaattcctgttggtaaattggccttgtacacagcactaggaggagttagaccatcagcatgtttgcctattacgattgatgtggggacaaacaatgaganattactaaatgatgagttttacattgggcttagacaaagagggcaactgggcagaatatctgaacttttgcacgagtccatgactgctgtcancaantacggagaanagtcttgtt

SEQ ID NO: 6232 - DNA, 261 bp, Glycine max
  Clone ID: 701141562H1
cttggatgctcggggatgggaattcctgttggtaaattggccttgcacacagcactaggaaccgttagaccatcagcatgtttgcctattacgattgatgtggggacaaacaatgagaaattacgcaatgatgagttttacattgggcttacacaaaagagggcaactgggcaggaatattctgaacttttgcacgagttcatgactgctgtcaagcaaaactacggagaaaaagttgcttgttcagtttgaagattttgc

SEQ ID NO: 6233 - DNA, 237 bp, Glycine max
  Clone ID: 701144577H1
ggatgggaattcctgttggtaaattggccttgtacacagcactaggactagttagaccatcagcatgtttgcctattacgattgatgtggggacaaacaatgagaaattactaaatgatgagttttacattgggcttagacaaaagagggcaactgggcaggaatattctgaacttttgcacgagttcatgactgctgtcaagcaaaactacggagaaaaagttcttgttcagtttg

SEQ ID NO: 6234 - DNA, 125 bp, Glycine max
  Clone ID: 700748911H1
tggggatcttggatgtcaggggatgggaattcctgttggtaaattggccttgtacacagcactaggagaagttagaccatcagcatgtttgcctattacgattgatgtggggacaaacaatgaga

SEQ ID NO: 6235 - DNA, 261 bp, Glycine max
  unsure (1)...(261): unsure at all n locations
  Clone ID: 700667578H1
gatatttcttggcatgtagaaaccacttattcttnctctctccaacccaacttcacaatctgagtgcacagctgaagnagcttatacatggagcaagggtaaagcaatctttgctagtggaagcccatttgatcctgttgaatatgaaggaaaactttttgttcctggacaggctaacaatgcttacatatttcctggttttggcttgggtttgatcatctctggtgcaattcgtgtgcgtgatgagatgctcttngcagc

SEQ ID NO: 6236 - DNA, 252 bp, Glycine max
  Clone ID: 701056334H1
tatggagcaagggtaaagcaatctttgctagtggaagcccatttgatcctgttgaatatgaaggaaaagtttttgttcctggacaggccaacaatgcttacatatttcctggttttggcttgggtttgatcatttctggtgcatccgcgtgcgtgatgagatgctcttggcagcctctgaagctttggctgcacaagtatcacaggagaactatgataaggggctgatttaccctccattctcaaacatcag

SEQ ID NO: 6237 - DNA, 183 bp, Glycine max
  Clone ID: 700742616H1
ggaagcccatttgatcctgttgaatatgaaggaaaactttttgttcctggacaggctaacaatgcttacatatttcctggttttggcttgggtttgatcatctctggtgcaattcgtgtgcgtgatgagatgctcttggcagcctctgaagctttggctgcacaagtatcacaggaaaactat

SEQ ID NO: 6238 - DNA, 285 bp, Glycine max
  Clone ID: 701051365H1
gtagggtacagcatctgtggtattagcaggattgcttgcatccctgaaattagttggtggaaccttagttgaccataccttcttattcctgggtgctggagaggctggaactggtatagctgagctgatagctcttgagatttcaaagcagactaaagctccagtggaagagacccgcaagaagatctggctcgtggactcaaagggacttattgttagctctcgtttggaatcacttcagcagttcaaaaagccttgggcccatgagcatgaacctgttaagag

SEQ ID NO: 6239 - DNA, 268 bp, Glycine max
  Clone ID: 701102792H1
ctgtggtattagcaggattgcttgcatccctgaaattagttggtggaacttagttgaccataccttcttattcctgggtgctggagaggctggaactggtatagctgagctgatagctcttgagatttcaaagcagactaaagctccagtggaagagacccgcaagaagatctggctcgtggactcaaagggacttattgttagctctcgtttggaatcacttcagcagttcaaaaagccttgggcccatgagcatgaacctgttaag

SEQ ID NO: 6240 - DNA, 270 bp, Glycine max
  Clone ID: 701098731H2
ctgaaattagttggtggaaccttagttgaccataccttcttattcctgggtgctggagaggctggaactggtatagctgagctgatagctcttgagatttcaaagcagactaaagctccagtggaagagacccgcaagaagatctggctcgtggactcaaagggacttattgttagctctcgtttggactcacttcagcagttcaaaaagccttgggcccatgagcatgaacctgttaagagtcttctggatgctgtcaaggcaatcaag

SEQ ID NO: 6241 - DNA, 251 bp, Glycine max
  Clone ID: 700744584H1
gtaacatagcagcaagtgtagctggcaaggcatatgagctacgcctggctactcgtctccctcgtcctcagaatcttgtcacatatgctgagagctgcatgtattctcctgccaacagaaactataggtgaattatggggcaagtcacttgactttggctgtaataaacacatgtcttggtggcatgtgtgagttgttttatgtaacttatgcataagtgagtggttttatgctatttattatgaaatcac

SEQ ID NO: 6242 - DNA, 268 bp, Glycine max
  unsure (1)...(268): unsure at all n locations
  Clone ID: 701000647H1
cacttggaggagtgcgcccttcagcttgtntgcctattaccattgatgtgggtacaaacaatgagaagctgctgaatgatgaattatacattgggctaaagcaaagacgagcaactgggcaggantatgctgaacttatgcacgantttatgacagcagtcaagcaaacttatggggaaaaagttctaattcagtttgaagactttgcaaaccacaatgccttttgatctgcttgaganatatagatctacacatctggtctttaatg

SEQ ID NO: 6243 - DNA, 257 bp, Glycine max
  Clone ID: 700738988H1
cttaaagggggaagatccgtgaagtgctaaggaattggcctgagaagaacattcaagtcatagttgtaactgatggagaacggatcctgggtcttggggatcttggttgtcaggggatgggaataccagtgggaaaactttctttatatacagcacttggaggagtgcgcccttcagcttgtttgcctattaccattgatgtgggtacaaacaatgagaagctgctgaatgatgaattatacattgggcacaagacg

SEQ ID NO: 6244 - DNA, 255 bp, Glycine max
  Clone ID: 700956234H1
ccttcagcttgtttgcctattaccattgatgtgggtacaaacaatgagaagctgctgaatgatgaattatacattgggctaaagcaaagacgagcaactgggcaggaatatgctgaacttatgcacgaatttatgacagcagtcaagcatactctatggggataaagttctaattcagtttgacgactttgcagaccactatgcttttgatctgcttgacgtatatagatctacacatctggtctttaatgatga

SEQ ID NO: 6245 - DNA, 178 bp, Glycine max
  Clone ID: 700888666H1
tattaccattgatgtgggtacaaacaatgagaagctgctgaatgatgaattatacattgggctaaagcaaagacgagcaactgggcaggaatatgctgacttatgcacgaatttatgacagcagtcaagcaaacttatggggaaaaagttctaattcagtttgaagactttgcaaacc

SEQ ID NO: 6246 - DNA, 279 bp, Glycine max
  Clone ID: 700752533H1
cattgatgtgggcacaaacaatgagaagctgctgaatgatgaattatatattgggctaaagcaaagacgagcaactgggcaggaatatgctgaacttatgcacgaatttatgacagcagtcaagcaaacttatggggaaaaggtcctaattcagtttgaagactttgcaaaccacaatgcttttaatctgcttgagaaatatagatctacacctctggtccttaatgatgatattcaggggacagcatccgtggttcttgctggactagttgcatctct

SEQ ID NO: 6247 - DNA, 142 bp, Glycine max
  Clone ID: 700685485H1
atggatcctgggtcttggggatcttggttgtcaggggatgggaataccagtgggaaaactttctttatatacaggacttggaggaatccgcacttcagcttgtttacccattacaattgatgtgggcacaaacatgagaagc

SEQ ID NO: 6248 - DNA, 124 bp, Glycine max
  unsure (1)...(124): unsure at all n locations
  Clone ID: 700998862H1
caaagacgngcaactgggcangnatatgctgaacttatgcacgantttatgacagcagtcaagcaaacttatgggganaaggtcctaattcagtttgangactttgccaaaccacaatgctttt

SEQ ID NO: 6249 - DNA, 114 bp, Glycine max
  Clone ID: 700729313H1
ggagtgcgcccttcagcttgtttgcctagtaccattgatgcgggtccaaacaatgagcagctgctgaatgatcaattatacattgggctaaagcaaagacgagcaactgggcag

SEQ ID NO: 6250 - DNA, 237 bp, Glycine max
  Clone ID: 700846094H1
gtggaactgcttccaattgtgtatactcctgttgttggtgaggcttgccagaaatatgggagcatcttcaagcgtcctcagggacttttcataagtttgaaagagaaggggaaggttcttgaagtattgaaaaactggcctgagaggagtattcaagttattgttgtaacagatggcgaacgaattttgggaattggggatcttggatgtcaggggataggaattcctgttggtaaa

SEQ ID NO: 6251 - DNA, 267 bp, Glycine max
  Clone ID: 701062346H1
ctcgagccgggcttgccagaaatatgggagcatcttcaagcgtcctcagggtcttttcatacggtttgaaagagaaggggaagattcttgaagtattgaaaaactggcctgagaaaagtattcaagttattgttgtaacagatggtgaacgaattttgggacttggggatcttggatgtcaggggatgggaattcctgttggtaaattggccttgtacacagcactaggaggagttagaccatcagcatgttgcctattacgattga

SEQ ID NO: 6252 - DNA, 228 bp, Glycine max
  Clone ID: 700866471H1
tagggagcatcttcaagcgtcctcagggtcttttcataagtttgaaagagaaggggaagattcttgaagtattgaaaaactggcctgagaaaagtattcaagttattgttgtaacagatggtgaacgaattttgggacttggggatcttggatgtcaggggatgggaattcctgttggtaaattggccttgtacacagcactaggaggcattagaccatcagcatgtt

SEQ ID NO: 6253 - DNA, 283 bp, Glycine max
  Clone ID: 701129419H1
ggagatgaggaacggtggtgaggattatagcaatggtcatggtggtggtgtaagggacttgtatggagaggattgtgccacagaggaccagcttatcaccccatggactttctctgtggccagtggatgcagtttgctgagagatccacgctacaacaaaggactggcctttactgagggagagagagatgctcattacttgcgtggccttttgcctccagctgtcttcaatcaagaacttcaggaaaagaggttgatgcacaatcttcgccagtatgaggtt

SEQ ID NO: 6254 - DNA, 251 bp, Glycine max
  Clone ID: 701099310H1
atctcgagcgtatcggctcgaggcttcgttgaaggagatgagactcggtggtgaggatactagcaatggtcatggtgacggtggtgtgagggacttgtatggagaggattgtgccactgaggaccagcttatcactccatggactttctctgtggccagtggatgcagtttactgagagatccacgctacaacaaagggctggcctttaccgagggagagagagatgctcattacttgcgtggccttttgc

SEQ ID NO: 6255 - DNA, 242 bp, Glycine max
  Clone ID: 701103522H1
gcttcgttgaaggagatgaggaacggtggtgaggattatagcaatggtcatggtggtggtggtgtgagggacttgtatggagaggattgtgccactgaggaccagcttatcactccatggactttctctgtggccagtggatgcagtttactgagagatccacgctacaacaaagggctggcctttaccgagggagagagagatgctcattacttgcgtggccttttgcctccagctatctt

SEQ ID NO: 6256 - DNA, 253 bp, Glycine max
  Clone ID: 701050730H1
gcttgtttgtgcctgcgtagttacaaagtaaaaagagggaggactaggacaaaagttgttggcagtcatcatgtcgagcgcttcgttgaaggagatgaggaacggtggtgaggattatagcaatggtcatggtggtggtggtgtgagggacttgtatggagaggattgtgccactgaggaccagcttatcactccatggactttctctgtggccagtggatgcagtttactgagagatccacgctacaacaaa

SEQ ID NO: 6257 - DNA, 284 bp, Glycine max
  Clone ID: 701045037H1
attctgttttccgctgcttgtttgtgcctgcgtagttacaaagtaaaaagagggaggactaggacaaaagttgttggcagtcatcatgtcgagcgcttcgttgaaggagatgaggaacggtggtgaggattatagcaatggtcatggtggtggtggtgtgagggacttgtatggagaggattgtgccactgaggaccagcttatcactccatggactttctctgtggccagtggatgcagtttactgagagatccacgctacaacaaagggctggcctttaccg

SEQ ID NO: 6258 - DNA, 259 bp, Glycine max
  Clone ID: 701050806H1
gctgcttgtttgtgcctgcgtagttacaaagtaaaaagagggaggactaggacaaaagttgttggcagtcatcatgtcgagcgcttcgttgaaggagatgaggaacggtggtgaggattatagcaatggtcatggtggtggtggtgtgagggacttgtatggagaggattgtgccactgaggaccagcttatcactccatggactttctctgtggccagtggatgcagtttactgagagatccacgctacaacaaaggg

SEQ ID NO: 6259 - DNA, 264 bp, Glycine max
  Clone ID: 700749793H1
cgctgcttgtttgtgcctgcgtagttacaaagtaaaaagagggaggactaggacaaatgttgttggcagtcatcatgtcgagcgcttcgttgaaggagatgaggaacggtggtgaggcttatagcaatggtcatggtggtggtggtgtgagtcacttgtatggagaggattgtgccactgaggaccagcttatcactccatggactttctctgtggccagtggatgcagtttactgagagatcaggctacaacaaagggctggc

SEQ ID NO: 6260 - DNA, 244 bp, Glycine max
  Clone ID: 701045082H1
atgagttctagaggagttcatgcgcgcagttaagcagaattatggggagaaagttctcgtacagtttgaggatttcgccaatcataatgcatttgatctgctggaaaaatacagctcatctcatcttgttttcaacgatgatatacagggtacagcatctgtggtattagcaggattgcttgcatccctgaaattagttggggggaccttagctgaccataccttcttattcctgggtgctgga

SEQ ID NO: 6261 - DNA, 117 bp, Glycine max
  Clone ID: 701118383H1
cgggcaactgggcaggaatatgcggacttctagaggagttcatgcgcgcagttaagcagaattatggggagaaagttctcgtacagtttgaggatttcgccaatcataatgcatttg

SEQ ID NO: 6262 - DNA, 244 bp, Glycine max
  Clone ID: 700737869H1
gttttccgctgcttgtttgtgcctgcgtagtacaaagtaaaagagggactagtacaaaagttgttggcagtgaccatgtcgagcacttcgttgaaggagatgaggaacggtggtgaggattatagcaatggtcatggtggtggtgtaagggacttgtatggagaggattgtgccacagaggaccagcttatcaccccatggactttctctgtggccagtggatgcagtttgctgagagatccac

SEQ ID NO: 6263 - DNA, 266 bp, Glycine max
  Clone ID: 701212666H1
gttttacattgggcttagacaaaagagggcaactgggcaggaatattctgaacttttgcacgagttcatgactgctgtcaagcaaaactacggagaaaaagttcttgttcagtttgaagattttgcaaaccacaatgcttttgagttgcttgcaaaatatggcacaactcatcttgttttcaacgatgatattcaggggactgcatctgttgttcttgctggggttgtggcagccttgaagctcattggaggtactctggctgacc

SEQ ID NO: 6264 - DNA, 290 bp, Glycine max
  Clone ID: 701212028H1
gtacacagcactaggaggagttcgaccatcagcatgtttgcctattacgatcgatgtggggacaaacaatgaaaaattactgaatgatgagttttacattgggctcagacaaaagagggcaactggacaggaatattctgaactcttgcaagagttcatgactgctgtcaagcaaaactatggagaaaaagttcttattcagtttgaagattttgcaaaccacaatgcttttgaattgcttgcaaaatatggcacaactcatcttgttttcaacgatgatattcagggga

SEQ ID NO: 6265 - DNA, 262 bp, Glycine max
  unsure (1)...(262): unsure at all n locations
  Clone ID: 700977561H1
ctgggcnggantattctnaacttttgcangagttcatgactgctgncaagcaaaactacggngaaanagttcttgttcagtttgangantttgcaaaccacaatgcttttgagttgcttgcaaaatatggcacaactcatcttgttttcaacgacgatattcaggggactgcatctgntgttcttgctggggttgtggcagccnnnaagctcattggaggtactctggctgaccacacattcttgtttcttggtgctggaga

SEQ ID NO: 6266 - DNA, 234 bp, Glycine max
  Clone ID: 700905407H1
tgagaaattactaaatgatgagttttacattgggcttagacaaaagagggcaactgggcaggaatattctgaacttttgcacgagttcatgactgctgtcaagcaaaactacggagaaaaagttcttgttcagtttgaagattttgcaaaccacaatgcttttgagttgcttgcaaaatatggcacaactcatcttgttttcaacgatgatattcaggggactgcatctgttgt

SEQ ID NO: 6267 - DNA, 258 bp, Glycine max
  Clone ID: 700792066H1
cgatgatattcaggggactgcatctgttgttcttgctggggttgtggcagccctgaagctcattggaggtactctggctgaccacacattcttgtttcttggtgctggagaggcaggaactggaatagcagaactaatagctcttgagatgtcaaagcagacaaagacacctatagaggagactgcgcaagaagatatggcttgtagactcaaagggtttgattgttggttcaagaagggcttcattcaacacttcaa

SEQ ID NO: 6268 - DNA, 256 bp, Glycine max
  Clone ID: 701128564H1
gagggcaactgggtaggaatattcagaacttttgcacgagatcatgactgctgtcaagcaaaactacggagaaaaagttcttgttcagtttgaagattttgcaaaccacaatgcttttgagttgcttgcaaaatatggcacaactcatcttgttttcaacgatgatattcaggggactgcatctgttgttcttgctggggttgtggcagccttgaagctcattggaggtactctggctgaccacacattcttgttt

SEQ ID NO: 6269 - DNA, 240 bp, Glycine max
  Clone ID: 700946436H1
gcatgagcctgttggcagtctcctagaagctgttaaggtaatcaagcctacagttttgattggatcatcaggagtgggaaaaacatttacaaaggaagtaattgaggctgtgacttctatcaatgaaaaacctcttgttttggccctctccaatccaacttcacagtctgagtgtacagctgaagaggcttacgaatggagtgagggtcgtgcgattttcgctagtggaagtccattgat

SEQ ID NO: 6270 - DNA, 274 bp, Glycine max
  Clone ID: 701137311H1
attcatgactgctgtcaagcaaaactacggagaaaaactgcttgttcagtctgaagattttgcaaaccacaatgcttttcagctgcttgcaaaatatggcacaactcatcttgttttcaacgatgatattcaggggactgcatctgttgttcttgctggggttgtggcagccttgaagctcattggaggtactctggatgaaccacacattcttgttccatggtgctggatacccaagaactggaataccaggacctaatagctcttgagatgt

SEQ ID NO: 6271 - DNA, 288 bp, Glycine max
  unsure (1)...(288): unsure at all n locations
  Clone ID: 700977732H1
attaaatcttctntcacaatatntgtnatnccangacaaaggcacctatanaggagnntcgcaagaagatatggcttgtaganttcaaagggtttgattgttggttcaagaaaggcttcacttcaacacttcaagcagccttgggctcatgagcatgagcctgtaggcagttctcttagaagctgttaaggtaatcaagcctacagttttgattgggtcatcaggagtgggaaaaactttacaaaggaagtattgaggctgtgacttctataaatgaaaaacctcttg

SEQ ID NO: 6272 - DNA, 243 bp, Glycine max
  Clone ID: 700843745H1
ctaaggcttatgagcttggcttggccactcgccttcctcaacctaaagatttggtgaagtttgcagagagctgtatgtataccccatcctaccgaagctaccggtgaagcgataataaatagcctatttttctttttccttttcgttttatcattttattgtcaattatttaatttttttaccttctttatgttgctgttctgttcttgtaagttatttgttgggttagtaggttaggacggt

SEQ ID NO: 6273 - DNA, 262 bp, Glycine max
  unsure (1)...(262): unsure at all n locations
  Clone ID: 700998015H1
gtctgggaccattcgagtgcatgatgacctgcttctggctgcctctgaggctttggctgcacaagtgagccaagagaactttgataagggactcatatacccaccattcaccaacataagaaagatttcagcacacatagctgccaatgttgctgctaaggcttatgagcttggcttggccactcgccttcctcaactaaagatttggtgaagtttgcagagagctgtatgtatcccccatcctancggaagtncnggngag

SEQ ID NO: 6274 - DNA, 285 bp, Glycine max
  Clone ID: 701051278H1
cgagaactttgataagggactcatatacccaccattcaccaacatcagaaagatttcagcacacatagctgccaatgttgctgctaaggcttatgaacttggcttggccactcgccttcctcaacctaaagatttagtgaagtttgcagagagctgtatgtataccccagcctacagaagctaccgatgaaaagtgatactaatagataggcgctttattctatttcatttatcatgatatcatttcattgtcaattttttaattttttaccttctttatgttcc

SEQ ID NO: 6275 - DNA, 184 bp, Glycine max
  Clone ID: 700742622H1
aagagaactttgataagggactcatatacccaccattcaccaacatcagaaagatttcagcacacatagctgccaatgttgctgctaaggcttatgaacttggcttggccactcgccttcctcaacctaaagatttagtgaagtttgcagagagctgtatgtataccccagcctacagaagcta

SEQ ID NO: 6276 - DNA, 264 bp, Glycine max
  Clone ID: 700672459H1
agcacacatagctgccaatgttgctgctaaggcttatgaacttggcttggccactcgccttcctcaacctaaagatttagtgaagtttgcagagagctgtatgtataccccagcctacagaagctaccgatgaaaagtgataataataaataggcgcttttttctttttcatttatcatgatatcatttcattgtcaattttttaattttttaccttctttatgttcctgttatgttttttgtaagttattgtatgggtgggtt

SEQ ID NO: 6277 - DNA, 272 bp, Glycine max
  Clone ID: 700668110H1
cgcacacatagctgccaatgttgctgctaaggcttatgaacttggcttggccactcgccttcctcaacctaaagatttagtgaagtttgcagagagctgtatgtataccccagcctacagaagctaccgatgaaaagtgataataataaataggcgcttttttctttttcatttatcatgatatcatttcattgtcaattttttaattttttaccttctttatgttcctgttatgttttttgtaagttatttgtattgggtgggttagtagg

SEQ ID NO: 6278 - DNA, 132 bp, Glycine max
  Clone ID: 701067027H1
ctcgagccgctcgagccggtttaataatgtctgggaccattcgagtgcatgatgacctgcttctggctgcctctgaggctttggctgcacaagtgagccaagagaactttgataagggactcatatacccac

SEQ ID NO: 6279 - DNA, 138 bp, Glycine max
  Clone ID: 700740551H1
gagaactttgataagggactcatatacccaccattcaccatcatcagaaagatttcagcacacatagctgccaatgttgctgctaaggcttatgagcttggcttggccactcgccttcctcaacctaaagatttggtg

SEQ ID NO: 6280 - DNA, 264 bp, Glycine max
  Clone ID: 700725450H1
gggaaaaacatttacaaaggaagtaattgaggctgtgacttctataaatgaaaaacctcttgtcctggctctctccaatccaacttcacagtctgagtgtacagctgaagaggcttatcaatggagtgagggtcgtgcaatttttgctagtggaagtccatttgatcctgtagaatacaagggcaaagtgtactattctggccaggccaacaatgcttacattttcccgggctttggtctggggttggtaatctcaggagcaat

SEQ ID NO: 6281 - DNA, 279 bp, Glycine max
  Clone ID: 700863501H1
tgcaatttttgctagtggaagtccatttgatcctgtagaatacaagggcaaagtgtactattctggccaggccaacaatgcttacattttcccgggctttggtctggggttggtaatctcaggagcaatcagagtgcatgatgatatgcttctagcagcttcggaagccttggctaaactagtgtccaacgagaactacgaaaagggcttgatttatccaccattctctaacatcagagaaatttcagctaacatagcagcaagtgtagctggcaaggc

SEQ ID NO: 6282 - DNA, 243 bp, Glycine max
  Clone ID: 700961324H1
ggaaagacatttacaaatgaagtaattgaggctgtgacttctatcaatgaaaaacctcttgttttggccctctccaatccaacttcacagtctgagtgtacagctgaagaggcttacgaatggagtgagggtcgtgcgattttcgctagtggaagtccatttgatcctgtagaatacaagggcaaagtgtactattctggccaggccaacaatgcatacatcttccccggctttggtcttggg

SEQ ID NO: 6283 - DNA, 297 bp, Glycine max
  unsure (1)...(297): unsure at all n locations
  Clone ID: 700648881H1
ccaacttcacagtctgagtgtacagctgagaggcttatcaatggagtgagggtcgtgcaatttttgctagtggaagtccatttgatcctgtagaatacaagggcaaagtgtactattctggccaggccaacaatgcttacattttcccgggctttggtctggggtggtaatctcaggagcaatcagagtgcatgatgatatgcttctagcagcttcggaancttggctaaactagtgtccaacgagactangaaagggttgattatccaccattctctaacatcagagatttcngnt

SEQ ID NO: 6284 - DNA, 126 bp, Glycine max
  Clone ID: 700727322H1
gtgagggtcgtgcgattttcgctagtggaagtccatttgatcctgtagaatacaagggcaaagtgtactattctggccaggccaacaatgcatacatcttccccggctttggtcttgggttggtaa

SEQ ID NO: 6285 - DNA, 381 bp, Glycine max
  Clone ID: LIB3055-009-Q1-N1-E5
tgagtcccttatcaaagatttcagcacacatagctgccaatgttgctgctaaggcttatgagcttggcttggccactcgccttcctcaacctaaagatttggtgaagtttgcagagagctgtatgtataccccatcctaccgaagctaccggtgaagcgataataaatagcctatttttctttttccttttcgttttatcattttattgtcaattatttaatttttttaccttctttatgttgctgttctgttcttgtaagttatttgttgggttagtaggttaggacggtggtagttggactaaaaaggtagcttgaaaatttgtgttctgctataaatgttatgtgacagtaatctaaattagaaaaggaagcatttct

SEQ ID NO: 6286 - DNA, 357 bp, Glycine max
  unsure (1)...(357): unsure at all n locations
  Clone ID: LIB3051-044-Q1-K1-A10
gaacagctgaggctttggctgcacaagtgagccaagagaactttgataagggactcatatacccaccattcaccaacatcagaaagatttcagcacacatagctgccaatgttgctgctaaggcttatgaacttggcttggccactcgccttcctcaacctaaagatttagtgaagtttgcagagagctgtatgtataccccagcctacagaagctaccgatgaaaagtgataataataaataggcgctnttttctttttcatttatcatgaaatcatttcattggcaattttttaaatttttaccttccttaaggtcctggtatggtttttggaaagtatttggattgggtgggtt

SEQ ID NO: 6287 - DNA, 284 bp, Glycine max
  Clone ID: LIB3050-004-Q1-E1-B1
acgcgtccggctgcgagaagacgacagaagggggagtgagggtcgtgcaatttttgctagcggaagtccatttgatcctgtagaatacaagggcaaagtgtactattctggccaagccaacaatgcttacattttcccgggctttggtctggggttggtaatctcaggagcaatcagagtgcatgatgatatgcttctagcagcttcggaagccttggctaaactagtgtccaacgagaactacgaaaagggcttgatttatccaacattctctaacatcagag

SEQ ID NO: 6288 - DNA, 259 bp, Zea mays
  Clone ID: 701172938H2
ctggagttgctctagcaggcctacttggtgctgttagagcacagggccgtcctctccaggattttacgaatcaaaagatagtcgttgtgggagctggaagaatccagtgctgggataggtgtgcttagcatggctaaacaggcaatgttaaggatgcctgggatccacagaaccggggaagggcataatcaattctgggttctggacaaagatggccttattacgaaagctaggaaggacctggattctgcagtggcgc

SEQ ID NO: 6289 - DNA, 259 bp, Zea mays
  Clone ID: 700217870H1
ccgtctcttacgcggctgcagctccgagcattggattccgaccaactgaccgatcggcgtgtcagatgatctcgccggatatgtgtcgttcggcgccgctgcgggccgcgcaggtccggcgcctcctgtcgtcggccgcgcccccggcgcacgccggcgctgccgtgcctgggccctgcatcgtgcacaagcgcggcaacgacatcctccacgatccgtggtacaacaaggatacggcgttccccatgacggagcgcga

SEQ ID NO: 6290 - DNA, 185 bp, Zea mays
  Clone ID: 700455719H1
atcaagtcgtcaactcgggctaatgacagcgctacatggcactcatggatctccaggacgggaacgagaggcttttctacaagttgccattgacaacgtcgaggagttacttccaatcgtgtacactccaaccgttggcgaggcctgccaaaagtatggatccatatttagtcgccctcagggtc

SEQ ID NO: 6291 - DNA, 272 bp, Glycine max
  unsure (1)...(272): unsure at all n locations
  Clone ID: 700565009H1
tttgttntaattttcttcgcttaagcgctgtagtaggtggtgttggttgtttggtgcatntgatttngatttggaattggaagaatgtggaaggttntgcgantcgcggcggcnagatcncggcngtantcgacggcgnttcccggtccangcnangttcacaagcgtggcacngatatcctccacgacccntggttcaacaaggatactgggtnncctgtanctganaggggncgatnggngctncngggctctgcttnntcctcttgtca

SEQ ID NO: 6292 - DNA, 271 bp, Glycine max
  Clone ID: 701041607H1
agcaggtagccacagctgttataaaagaagcagtggaggaggacctagctgaaggatatcatggaatggatgctcgggagtgcagaaactaagcgaggatgaaatcgcggaatatgtgcagaataacatgtggagtccagagtaccctacattagtttacaagaaagaatgagtaacctgcagggttgataactacaatttccctctcgatgcatgtttggttcgatcaggttgttcacagaatcctgtttactggattagatgatttaaa

SEQ ID NO: 6293 - DNA, 357 bp, Glycine max
  Clone ID: LIB3051-012-Q1-E1-H7
agcggacgcgtgggcggacgcgtgggcggacgcgtgggcggacgcgtgggcggacgcgtgggcggacgcgtgggtgcaagtggaagcccttttgaaaatgtagatcttggaaatggagaagttggccatgtaaatcaagccaacaacatgtacctgtttccagggtaggcatgcctttgtggcttatattttttcacggatcatgccactcagtggaaacattggcagaatgttcgaccgcaacatttcatttcaggattggtttggggacacttttatcacgtgctcgtcatataacagatggaatgttgcgagcagcagccgaatgcgcagtaatgcaggtgtggcaaaatggga

SEQ ID NO: 6294 - DNA, 247 bp, Zea mays
  Clone ID: 700442004H1
gccagctacaagatcggggacgacagctgcctgactgacgagatcctcgccgcaggcccaacttctgaactaaagcaatggatccggatgaataaaacgatggtgtgtgtgcgagcgtgcgtgtgaagatgattacgacgcgacgacgaaaaaaaggtgttggatcgatggccaacatagtaattgattagcctgggtattgtcatgaggtgcgtctggtgttgttatctataacgctgtctgcctg

SEQ ID NO: 6295 - DNA, 299 bp, Zea mays
  unsure (1)...(299): unsure at all n locations
  Clone ID: 700579766H1
gccagctacaagatcggggncgacagcagcctgactgacgagatcctcgccgcagccccaacttctgaactaaagcaatggatccggatgaataaaacgatggtgtgtgtgcgtgcgtgcgtgtgaagatgattacgacgacgacgactgcgaaaaggtgttngatcgatgagccaacatagtaatagattagctgggtattgtcatgggtgcgtctggtgttgttatctataaggctgtctgcctgtcccaagcagctatcatattctatgtcaaattctattctgtaagcgtgtagt

SEQ ID NO: 6296 - DNA, 336 bp, Zea mays
  Clone ID: 700619673H1
gtgttcgccagctacaagatcggggacgacagcaacctgaccgacgagatcctcgccgcagccccaacttctgaactaaagcagtgggtccggatgaataaaacggtggtatgcgtgtgaagaagatgatgatgacgacgaaaaaagtgtgttggatcgatgggccaacacagtgtagactagcttttgtatattatctcgggttggaaatctggtgttgttacctaaaatgttggtttctatcggcttgttgaaaacagtttgcgcgtgcttgcatcttggcccccccctgtattctctgtggtttcagaatttgaacacgaaacagcttggtct

SEQ ID NO: 6297 - DNA, 350 bp, Zea mays
  Clone ID: 700620909H1
tagagagcactgctggagcgagaatggcgtgtccaacatcgagggcggctgctatgccaagtgcatagacctgtcgcaggagaaagagcccaagcgcggcatcctctcgctgcactccggctgcaatatgggcaaggacggcgacgtcgccctcttctttggcctctcaggtaccgggaagacgacgctgtcgacggatcacaacaggcttctgatcggcgacgacgagcactgctggagaacgttgtcttcgatgagcatactcgtgaagttgactacgccgacaaatctgtcaccgagaacactcgggctgcctacccgatcgagtacatcccaacgccaagatacat

SEQ ID NO: 6298 - DNA, 332 bp, Zea mays
  Clone ID: 700620957H1
gacgagcactgctggagcgagaatggcgtgtccaacatcgagggcggctgctatgccaagtgcatagacctgtcgcaggagaaagagcccaagcgcggcatcctctcgctgcactccggctgcaatatgggcaaggacggcgacgtcgccctcttctttggcctctcaggtaccgggaagacgacgctgtcgacggatcacaacaggcttctgatcggcgacgacgagcactgctggagaacgttgtcttcgatgagcatactcgtgaagttgactacgccgacaaatctgtcaccgagaacactcgggctgcctacccgatcgagtacatc

SEQ ID NO: 6299 - DNA, 320 bp, Zea mays
  Clone ID: 700098127H1
atcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaggagaatctcctgaggctcggcgggctcttcaagaagaacttcgaggtgttcgccagctacaagatcggggacgacagcagcctgactgacgagatcctcgccgcaggcccaacttctgaactaaagcaatggatccggatgaataa

SEQ ID NO: 6300 - DNA, 279 bp, Zea mays
  Clone ID: 700243074H1
cagtacggtgtgggcaagaggatccggcttccctacaccaggaagatcatcgacgccatccactccggcgagcttctcaccgccaactaccagaagaccgaggtctttggcctggagatcccgactgagatcaagggcgtgccgtcggaaatcctcgacccaatcaacacctggacggacaaggccgcgtacaaggagacgctcctgaggcttgccgggctcttcaagaagaacttcgaggtgttcgccagctacaagatcggggacgacagcaacctg

SEQ ID NO: 6301 - DNA, 308 bp, Zea mays
  Clone ID: 700098909H1
cgacgccatccactccggcgagctcctcaccgccaactaccagaagaccgaggtgtttggcctggagatccccactgagatcaacggcgtgccgtcggaaatcctcgacccgatcaacacctggacgggacaaggccgcgtacaaggagaatctcctgaggctcggcgggctcttcaagaagaacttcgaggtgttcgccagctacaagatcggggacgacagcagcctgactgacgagatcctcgcagcaggccccaacttctgaactaaagcaatggatccggatgaataaaacgatggtgtgtgt

SEQ ID NO: 6302 - DNA, 280 bp, Zea mays
  Clone ID: 700578805H1
gccaccgggtggctcgtcaacaccggctggtctggtggcaggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaggagaatctcctgaggctcggcgggctcttcaagaagaacttcgagg

SEQ ID NO: 6303 - DNA, 251 bp, Zea mays
  Clone ID: 700577590H1
atcaaggagccgcaggcaccttctccgcctgcttcggcgcggccttcatcatgctccacccgaccaagtacgccgccatgctcgccgagaagatgcagaagtacggcgccaccgggtggctcgtcaacaccggctggtcgggtggcaggtacggcgtgggcaagaggatcaggcttccctacaccagaaagatcatcgacgccatccactccggcgagctcctcaccgccaactaccagaagaccgaggtg

SEQ ID NO: 6304 - DNA, 264 bp, Zea mays
  Clone ID: 700576768H1
cgagaagatgcagaagtacggcgccaccgggtggctcgtcaacaccggctggtctggtggcaggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaggagaatct

SEQ ID NO: 6305 - DNA, 250 bp, Zea mays
  Clone ID: 700025522H1
ctcgccgagaagatgcagaagtacggcgccaccgggtggctcgtcaacaccggctggtcgggtggcaggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaagg

SEQ ID NO: 6306 - DNA, 244 bp, Zea mays
  Clone ID: 700197175H1
atccggcttccctacaccaggaagatcatcgacgccatccactccggcgagcttctcaccgccaactaccagaagaccgaggtctttggcctggagatcccgactgagatcaagggcgtgccgtcggaaatcctcgacccaatcaacacctggacggacaaggccgcgtacaaggagacgctcctgaggcttgccgggctcttcaagaagaacttcgaggtgttcgccagctacaagatcgggg

SEQ ID NO: 6307 - DNA, 266 bp, Zea mays
  Clone ID: 700432603H1
tgctcgccgagaagatgcagaagtacggcgccaccgggtggctcgtcaacaccggctggtcgggtggcaggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaggag

SEQ ID NO: 6308 - DNA, 253 bp, Zea mays
  Clone ID: 700193379H1
aggagccacaggccaccttctccgcctgcttcggcgcggccttcatcatgctccacccgaccaagtacgccgccatgctcgccgagaagatgcagaagtacggcgccaccgggtggctcgtcaacaccggctggtctggcggcaggtacggtgtgggcaagaagatccggcttccctacaccaggaagatcatcgacgccatccactccggcgagcttctcaccgccaactaccagaagaccgacgtctttgg

SEQ ID NO: 6309 - DNA, 168 bp, Zea mays
  Clone ID: 700196761H1
aggacccacaggccaccttctccgcctgcttcggcgcggccttcatcatgctccacccgaccaagtacgccgccatgctcgccgagaagatgcagaagtacggcgccaccgggtggctcgtcaacaccggctggtctggcggcaggtacggtgtgggcaagaggatcc

SEQ ID NO: 6310 - DNA, 180 bp, Zea mays
  Clone ID: 700441535H1
gctcgagcgtgctcgaggagctcctcaccgccaactaccagaagaccgaggtgtttggcctggagatccccactgagatcaacggcgtgcgtcggaaatcctcgacccgatcaacacctggacggacaaggccgcgtacaaggagaatctcctgaggctcggcgggctcttcaagaagaa

SEQ ID NO: 6311 - DNA, 111 bp, Zea mays
  Clone ID: 700158221H1
ggacaaggccgcgtacaaggagacgctcctgaggcttgccgggctcttcaagaagaacttcgaggtgttcgccagctacaagatcggggacgacagcaacctgaccgacga

SEQ ID NO: 6312 - DNA, 316 bp, Zea mays
  Clone ID: 700101572H1
gatatttggaacgccatcaagtttggaactgtgctggagaacgtggtctttgatgagcatactcgtgaagtcgactacgccgacaactctgtcaccgagaacactcgggctgcctacccgatcgagtacatccccaacgccaagataccatgcgtcggcccgcaccccaagaacgtgatcctcctggcgtgcgacgccttcggcgtgctcccgccggtgagcaagctgaacctggcgcagaccatgtaccacttcatcagcggctacaccgctctggtcgccggcacggaggacggcatcaaggagccgcacgcac

SEQ ID NO: 6313 - DNA, 292 bp, Zea mays
  Clone ID: 700099023H1
cccacgcgtccggctgctacgccaagtgcatcgacctggcgcaggagaaagagcctgatatttggaacgccatcaagtttggaactgtgctggagaacgtggtctttgatgagcatactcgtgaagtcgactacgccgacaactctgtcaccgagaacactcgggctgcctacccgatcgagtacatccccaacgccaagataccatgcgtcggcccgcaccccaagaacgtgatcctcctggcgtgcgacgccttcggcgtgctcccgccggtgagcaagctgaacctggc

SEQ ID NO: 6314 - DNA, 273 bp, Zea mays
  Clone ID: 700577054H1
gtgaagtcgactacgccgacaactctgtcaccgagaacactcgggctgcctacccgatcgagtacatccccaacgccaagataccatgcgtcggcccgcaccccaagaacgtgatcctcctggcgtgcgacgccttcggcgtgctcccgccggtgagcaagctgaacctggcgcagaccatgtaccacttcatcagcggctacaccgctctggtcgccggcacggaggacggcatcaaggagccgcaggcaccttctccgcctgcttcggcgc

SEQ ID NO: 6315 - DNA, 289 bp, Zea mays
  Clone ID: 700458441H1
cggctcgagtgagcatactcgtgaagttgactacgccgacaaatctgtcaccgagaacactcgggctgcctacccgatcgagtacatccccaacgccaagataccatgcgtcggcccacaccccaagaacgtgatcctgctggcgtgctacgccttcggctcgctcccgccggtgagcaagctggacctggcgcagaccatgtaccacttcatcagcggatacaccgccctggtcgccggcacggaggacggcatcaaggagccacaggccaccttctccgcctgcttt

SEQ ID NO: 6316 - DNA, 320 bp, Zea mays
  Clone ID: 700101950H1
aggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcgggcgccactcggccttcgccgtcgcgatgtccgaggaagagcgccacacgcagcagatgcagtccatcagtgcgtcgttggcgtctctgacgcggtgaaccgggccgaaag

SEQ ID NO: 6317 - DNA, 310 bp, Zea mays
  Clone ID: 700101726H1
cctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcagtcgctgcagcggaagcgggtcggcgcgcagcacgcccaagcggtcggcgcccaccacgcccatcaagggcggcgcccactcgcgcttcgccgtcgcgatgtccgaggaggagcgccacacgcagcagatgc

SEQ ID NO: 6318 - DNA, 242 bp, Zea mays
  Clone ID: 700045944H1
ctcgtttcctgtcgaaagcccgcgcacgcacgtcggtcgtcccgagcaggacctcgatcggccgagatggcggacgccgaacgggcttgcgcggatggagacgaccgggaagaagaagcaggacaacggcgtgtggtacgacgacagctcggcgccggtgcgcgcgcagaccatcgacgagctgcactcgctgcagcggaacgtgtcggcgcccagcacgcccaatctgtcggcgcccacca

SEQ ID NO: 6319 - DNA, 313 bp, Zea mays
  Clone ID: 700099310H1
cactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgggcgcgcagaccatcgacgagctgcactcgctgcagcggatacggtcggcggccagcacgcccaagccgtcggcgcccaccacgcccatcaagggcggcgccgactcgcccttcggcgtcgcgatctccgacgaggagcgcacacgagcaga

SEQ ID NO: 6320 - DNA, 302 bp, Zea mays
  unsure (1)...(302): unsure at all n locations
  Clone ID: 700097484H1
cccacgcgtccgcccacgcgtccgcgctcgttccctttcgaaagcccgcgcacgcacgtcggtcgtcccgagcaggacctcgatcggccgagatggcgacgccgaacgggcttgcgcggatcgagacgaccgggaagaagaagcatgacaactgcgtgtggtacgacgacagctcggcgccggtgcgcgcgcagaccatcgacgagctgcactcgctgcagcggaagcgntcggcgcccagcacgcccaagcagtcggcgcccaccacgcccatcaatggcggtgcccactcgcccttcgcc

SEQ ID NO: 6321 - DNA, 224 bp, Zea mays
  Clone ID: 700101996H1
catcatcgctcgttccctttcgaaagcccgcgcacgcacgtcggtcgtcccgagcaggacctcgatcggccgagatggcgacgccgaacggggttgcgcggatcgagacgaccgggaagaagaagcaggacaacggcgtgtggaccgacgacaggtcggcgccggtgcgcgcgcagaccatcgacgaggtgcagtcggtgcagcggatagcgtcggcgcgcagc

SEQ ID NO: 6322 - DNA, 217 bp, Zea mays
  Clone ID: 700168982H1
ccgcttcactcgtttccttccgatccatacacaccgcgcacgtacgcgtactccatcgtcccggtgcaggcgggttcacgtacgagctcgatcggccgagacgagatggcgacgccgaacgggcttgctcggatcgagacgaacggggcgacgaagcccgacaacggcgtgtgccacgacgacagctcggcgccggtgcgcggcagaccatcgacga

SEQ ID NO: 6323 - DNA, 303 bp, Zea mays
  Clone ID: 700098761H1
cgcccaacatcgagatggacgagaagacgttcctgatcaacagggagagggccgtcgactacctcaactccctggagaaggtgttcgtcaacgaccagtacctcaactgggaccccgagaaccggatcaaggtccgcatcatctccgccagggcgtaccactccctcttcatgcacaacatgtgcatccggcccacggacgaggagctggaggacttcggcacgccggacttcaccatctacaacgcaaggcagttcccctgcaaccgctacacccactacatgacgtcgtccacgagcatag

SEQ ID NO: 6324 - DNA, 256 bp, Zea mays
  Clone ID: 700240336H1
acctcaactccctggacaaggtgttcgtgaacgaccagttcctcaactgggacccggagaaccggatcaaggtccgcatcatctccgccagggcgtaccactccctcttcatgcacaacatctgcatccggcccacggacgaggagctggagagcttcggcacgccggacttcaccatctacaacgccggccagttcccctgtaaccgctacacgcactacatgacgtcgtccaccagcgtagacatcaacctcgc

SEQ ID NO: 6325 - DNA, 234 bp, Zea mays
  Clone ID: 701158475H1
gggacccggagaaccggatcaaggtccgcatcatctccgccagggcgtaccactccctcttcatgcacaacatctgcatccggcccacggacgaggagctggagagcttcggcacgccggacttcaccatctacaacgccggccagttcccctgtaaccgctacacgcactacatgacgtcgtccaccagcgtagacatcaacctcgccaggagggagatggtgatcctgggca

SEQ ID NO: 6326 - DNA, 279 bp, Zea mays
  Clone ID: 700028978H1
gcccaagcgcggcatcctctcgctgcactccggctgcaatatgggcaaggacggcgacgtcgccctcttctttggcctctcaggtaccgggaagacgacgctgtcgacggatcacaacaggcttctgatcggcgacgacgagcactgctggagcgagaatggcgtgtccaacatcgagggcggctgctatgccaagtgcatagacctgtcgcaggagaaagagcctgatatctggaacgccatcaagttcggagccgtgctggagaacgttgtcttcga

SEQ ID NO: 6327 - DNA, 269 bp, Zea mays
  Clone ID: 700440427H1
ctttggcctctcaggtaccgggaagacgacgctgtctacggatcacaacaggcttctgatcggcgacgacgagcactgctggagcgacaatggcgtgtccaacatcgagggaggctgctacgccaagtgcatcgacctggcgcaggagaaagagcctgatatttggaacgccatcaagtttggaactgtgctggagaacgtggtctttgatgagcatactcgtgaagtcgactacgccgacaactctgtcaccgagaacactcgggctg

SEQ ID NO: 6328 - DNA, 280 bp, Zea mays
  Clone ID: 700440419H1
ctttggcctctcaggtaccgggaagacgacgctgtcgacgaaacacaacaggcttctgatcggcgacgacgagcactgctggagcgacaatggcgtgtccaacatcgagggaggctgctacgccaagtgcatcgacctggcgcaggagaaagagcctgatatttggaacgccatcaagtttggaactgtgctggagaacgtggtctttgatgagcatactcgtgaagtcgactacgccgacaactctgtcaccgagaacatcgggctgcctacccgatcg

SEQ ID NO: 6329 - DNA, 279 bp, Zea mays
  unsure (1)...(279): unsure at all n locations
  Clone ID: 700578684H1
tagacctcaacctcgccaggagggagatggtcatcatgggcacgcagtacgccggcgagatgaagaaggggctcttcggcgtcatgcactacctcatgcccaagcgcggcatcctctcgctgcactccggctgcaatatgggcaagacggcgacgtcgccctcttctntggcctctcaggtacggggaaacgacgctgtcgacggatcacaacaggcttctgatcggcgacgacgaagcactgttggagcgacaatggcgtgtcaaacatcgagggagg

SEQ ID NO: 6330 - DNA, 471 bp, Zea mays
  Clone ID: LIB143-017-Q1-E1-G12
agggcctgtgacaacgttgacacctgtctacgctgcgagagcggtctagggtccaggaccgtccagcagcacaagatcggggacgacagcagcctgactgacgagatcctcgcagcaggccccaacttctgaactaaagcaatggatccggatgaataaaacgatggtgtgtgtgcgtgggtgcgtgtgaagatgattacgacgacgacgaaaaaaaaggtgttggatcgatgagccaacatagtaatagattagctgggtatattgtcatgggtgcgtctggtctctggtcttgttatctataaagctgtctcaagcagctatcatattctatttcaaattctattctgtaagcgtgtagttcaaaacaatgctttacacaaccatatgcacagtctatctaaggttggtctgttctatcagcttgttgggaaaagtttgcgtgtgcttgtatcttgccccctgtactct

SEQ ID NO: 6331 - DNA, 93 bp, Zea mays
  Clone ID: LIB189-018-Q1-E1-A7
aacggacgcgtgggcggacgcgtgggcggacgcgtggggcacgcagtacgccggcaaaatgaaaaagggctcctccgcgtcatgcactaactc

SEQ ID NO: 6332 - DNA, 223 bp, Zea mays
  Clone ID: LIB3060-022-Q1-K1-A10
cgctcgttccctttcgaaagcccgttcacgtacgtcggtcgttccgagcaggacctcgatcgtgcgagatggcgactccgaacgggcttgcgcggatcgagacgaccgggaagaagaagcatgacaactgcgtgtggtacgacgacagctcggcgccggtgcgcgcgcagaccatcgacgagctgtactcgctgcagcggaagctgtcggcgcccatcacgcc

SEQ ID NO: 6333 - DNA, 441 bp, Zea mays
  unsure (1)...(441): unsure at all n locations
  Clone ID: LIB3069-045-Q1-K1-A5
cgcctgcttcggcgcggccttcattatgcttcacccgaccaagtacgccgccatgctcgccgagaagatgcagaagtacggcgccacagggtggctcgtcaacaccggctggtctggcggcaggtacggtgtgggcaagaggatccggcttccctacaccaggaagatcatcgacgccatccactccggcgagcttctcaccgccaactaccagaagaccgaggtctttggcctggagatcccgactgagatcaagggcgtgccgtcggaaatcctcgacccaatcaacacctggacggacaaggccgcgtacaaggagacgctcctgaggcttgccgggctcttcaagaagaacttcgaggtgttcgccagctacaagatcggngacgacagcaacctgaccgacgagatcctcgccgcaggccccaacttctgaactaa

SEQ ID NO: 6334 - DNA, 408 bp, Zea mays
  Clone ID: LIB189-002-Q1-E1-F5
agcccacgcgtccgcccacgcgtccgcacccgaccaagtacgccgccatgctcgccgagaagatgcagaagtacggcgccaccgggtggctcgtcaacaccggctggtctggtggcaggtacggcgtgggcaagaggatcaggcttccctacaccagaaagatcatcgacgccatccactccggcgagctcctcaccgccaactaccagaagaccgaggtgtttggcctggagatccccactgagatcaacggcgtgccgtcggaaatcctcgacccgatcaacacctggacggacaaggccgcgtacaaggagaatctcctgaggctcggcgggctcttcaagaagaacttcgaagtgttcgccagctacaagatcggggacgacagcagcctgactgacgagatcc

SEQ ID NO: 6335 - DNA, 307 bp, Zea mays
  Clone ID: LIB84-013-Q1-E1-D8
aagtacggcgtgggcaagaggatcaggcttccctacaccagaaagatcatcgacgccatccactccggcgagctcctcaccgccaactaccagaagaccgaggtgtttggcctggagatgcccactgagatcaacggggtgccgtcggaaatcctcgacccgatcaacacctggacggacaaggtcgcgtacaaggagaatctcctgaggctcggcgggctcttcaagaagaacttcgaggtgttcgccagctacgacatcggggacgacagcagcctgactgacgagatcctcgccgcaggcccca

SEQ ID NO: 6336 - DNA, 382 bp, Zea mays
  Clone ID: LIB143-049-Q1-E1-D10
aggaagatcatcgacaccatccactccggcgagcttctcaccgccaactaccagaagaccgaggtctttggcctggagatcccgactgagatcaagggcgtgccgtcggaaatcctcgacccaatcaacacctggacggacaaggccgcgtacaaggagacgctcctgaggcttgccgggctcttcaagaagaacttcgaggtgttcgccagctacaagatcggggacgacagcaacctgaccgacgagatcctcgccgcaggccccaacttctgaactaaagcagtgggtccgtccggatgaataaaacggtggtatgcgtgtgaagaagaagatgatgacgacgaaaaaagtgtgttggatcgatgggccagcacagtgt

SEQ ID NO: 6337 - DNA, 421 bp, Zea mays
  unsure (1)...(421): unsure at all n locations
  Clone ID: 10-LIB189-016-Q1-E1-C9
ctacgccaagtgcatcgacctggcgcaggagaaagagcctgatatttggaacgccatcaagtttggaactgtgctggagaacgtggtctttgatgagcatactcgtgaagtcgactacgccgacaactctgtcaccgagaacactcgggctgcctacccgatcgagtacatccccaacgccaagataccatgcgtcggcccgcaccccaagaacgtgatcctcctggcgtgcgacgccttcggcgtgctcccgccggtgagcaagctgaacctggcgcagaccatgtaccacttcatcagcggctacacngctctggtcgccggcacggaggacggnatcaagganccgcaggcancttttccgcctggttngggggngggcnttaaannangcccnaacccgnacnaatttccccgccnt

SEQ ID NO: 6338 - DNA, 465 bp, Zea mays
  unsure (1)...(465): unsure at all n locations
  Clone ID: LIB3060-018-Q1-K1-C8
acgacgacagcgtcggtcgccggtgccgcgcgccagaccatctgacgaagctgcacgtcgcgtgcgagcggaagcgagtcggcgcgccagcacgcctcaagcgtgtcggcgccccaccacgccgcatcaaggggcggtgtcccactcgcccttcgccagtcgcgatcatccgaggtaggagcgccacactgccagcagatgcagtcgcatcnagtgcgtccgttggcgtactctgacgcgtgagaaccgggaccgaaagtgcgtcaaggggcgaacccggccagcgaaggtgcgagtgccgtccgcgccagggcagccgccatcgacgaccgagggtcgcaccaggcagcactcnacaccgccgccgcccccgccatcgccgtcagcgacagctccctcaagttcactcatgtgctcaacaacctctcgcctgctgagctgtacgagcaggccatcaagtacgag

SEQ ID NO: 6339 - DNA, 507 bp, Zea mays
  unsure (1)...(507): unsure at all n locations
  Clone ID: LIB3060-028-Q1-K1-F4
ngaggtagtgcaggattgttatggagacgcgggggggaagggagtgctgcccaattcccgggctcgttccctttcgaaagcccgcgcacgcacgtcggtcgtcccgagcaggacctcgatcggccgagatggcgacgccgggacgggcgttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaagggcgaggccgccgcgcagggcgcgccatcgacgccgagggcgcaccagca

SEQ ID NO: 6340 - DNA, 483 bp, Zea mays
  Clone ID: LIB143-052-Q1-E1-B12
cgtcctgtaacatcatactgcagaccaatactaggactcgtgggtcgatgcaagcctctaaagtgagtcatatgacgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaagggcgaggccgccgcgcagggcgcgccatcgacgccgagggcgcaccagcagcaccgccaccccgccgcccccgccat

SEQ ID NO: 6341 - DNA, 406 bp, Zea mays
  Clone ID: LIB3060-025-Q1-K1-F9
cgtcggtcgtcccgagcaggacctctatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaagggcgaggccgccgcgcatggcgcgccatcgacgccgagggcgc

SEQ ID NO: 6342 - DNA, 404 bp, Zea mays
  Clone ID: LIB3060-005-Q1-K1-G11
cactcgtttcctttcgaaagcccgcgctcgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaagggagaggcc

SEQ ID NO: 6343 - DNA, 374 bp, Zea mays
  Clone ID: LIB3060-045-Q1-K1-A8
cgctcgttccctttcgaaagcccgcgcacgcacgtcggtcgtcccgagcaggacctggatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtc

SEQ ID NO: 6344 - DNA, 389 bp, Zea mays
  Clone ID: LIB3060-036-Q1-K1-G2
cgcttcatcactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgaggaggagcgccacacgcagcagatgcagtccatcagtgcgtcgttggcgtctctgacgcgtgaaaccgggccgaaagtggtcaagggcg

SEQ ID NO: 6345 - DNA, 360 bp, Zea mays
  Clone ID: LIB3060-045-Q1-K1-E8
gcttcatcgctcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgt

SEQ ID NO: 6346 - DNA, 366 bp, Zea mays
  unsure (1)...(366): unsure at all n locations
  Clone ID: LIB3060-001-Q1-K2-G11
cgctcgttccctttcgaaagcccgcgcacgcacgtcggtcgtcccgagcaggacctcgagcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcaatgcgtcgntggcgtctctgacgcgtgaaaccgggcccg

SEQ ID NO: 6347 - DNA, 354 bp, Zea mays
  Clone ID: LIB3060-007-Q1-K1-A4
cactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgaggaggagcgccacacgcagcagatgcagtccatcagtgcgtcgttggcgtctctgacgcgtg

SEQ ID NO: 6348 - DNA, 438 bp, Zea mays
  Clone ID: LIB3060-007-Q1-K1-D2
cgctcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaagggcgaggccgtcgcgcagggcgcgccatcgacgccgagggcgc

SEQ ID NO: 6349 - DNA, 382 bp, Zea mays
  Clone ID: LIB189-007-Q1-E1-H6
agcggacgcgtgggctcgtttcctttcgaaagcccgcgcacgcacgtcggtcgtcccgagcatgacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccatcgccgtcgcgatctccgaggaggagcgccacacgcagcagatgcagtccatcagtgcgtcgttggcgtctctgacgcgtgacagcgggccgaaagt

SEQ ID NO: 6350 - DNA, 360 bp, Zea mays
  unsure (1)...(360): unsure at all n locations
  Clone ID: LIB143-067-Q1-E1-E12
acgcttcactcgtttccttccgatccatacacaccgcgcacgtacgcgtactccatcgtcccggtgcaggcgggttcacgtcacgacctcgggcgagacgagatggcgacgccgaacgggcttgctcggatcgagacgaacggggcgaccaagcccgacaacggcgtgtgccacgacgacagctcggcgccggtgcgcgcgcagaccatcgacgagctgcactcgctgcagcggaagcggtcggcgccaaacacgcccatcaaagacggcgccgcctcgaccttcgccgccgcgctctccgangangagcgccacaggcagcagctgcagtccatcagcgcgtcgttggcgtctctgaca

SEQ ID NO: 6351 - DNA, 450 bp, Zea mays
  Clone ID: LIB3060-024-Q1-K1-F3
aagggctcgcccaacatcgagatggacgagaagacgttcctgatcaacagggacagggccggctactacctcaactccctggagaaggtgttcgtcaacgaccagtacctcaactgggaccccgagaaccggatcaaggtccgcatcatctacggcagggcgtaccactccctcttcatgcacaacatgtgcatccgccccacggacgaggagctggaggacttcggcacgccggacttcaccatctacaacgcagggcagatcccctgcaaccgctacacccactacatgacgtcgtccacgagcatagacctcaacctcgccaggagggagatggtcatcatgggcacgcagtacgccggcgagatgaagaaggggctcttcggcgtcatgcactacctcatgcccaagcgcggcatcctctcgctgcactccggctgcaatatgggc

SEQ ID NO: 6352 - DNA, 372 bp, Zea mays
  Clone ID: LIB189-023-Q1-E1-H8
agcccacgcgtccgggtcatcatgggcacgcagtacgccggcgagatgaagaaggggctcttcggcgtcatgcactaactcatgcccaagcgcggcatcctctcgctgcactccggctgcaatatgggcaaggacggcgacgtcgccctcttctttggcctcccaaggaacgggaagaccaagctgtccaacgattaaaacaagcttctgatcggcgacgacgagcactgctggagcgacaatggcgtgtccaacatcgagggaggctgctacgccaagtgcatcgacctggcgcaggagaaagagcctgatatttggaacgccatcaagtttggaactgtgctggagaacgtggtctttgatgagcatact

SEQ ID NO: 6353 - DNA, 350 bp, Zea mays
  unsure (1)...(350): unsure at all n locations
  Clone ID: LIB3060-013-Q1-K1-F1
gtcgtccacgagcatagacctcaacctcgccaggagggagatggtgatcatgggcacgcagggcgccggcgagatgaagaaggggctcttcggcgtcatgcactacctcatgcccaagcgcggcatcctctcgctgcactccggctgcaatatgggcaaggacggcgacgtcgccctcttctttggcctctcaggtaccgggaagacgacgctgtcgacggatcacaacaggcttctgatcggcgacgacgagcactgctggagcgacaatggcgtgtccaacatcgagggaggctgctacgccaagtgcatcgacctggcgcangagaaagagcctgatatttggaacg

SEQ ID NO: 6354 - DNA, 252 bp, Glycine max
  unsure (1)...(252): unsure at all n locations
  Clone ID: 700654736H1
caaaacttgatggggatttttggggagctacgngncagatgtagctttgtaatnataatcatccattacaagagaacantgctgataattatatgnctgcntggtaatttttattgcagaaaaganctcgtgcngcttatcctatagagtacattccanatgcaaagtnaccttgtgttggccctcacccaaagaatgtcatacttttggcatgtgacgcatntggtgtactcccacccgtnagcaagctaa

SEQ ID NO: 6355 - DNA, 251 bp, Glycine max
  Clone ID: 700848574H1
caaagatggcgatgttgcactctttttttggattatcaggtactggaaagacaactctgtctaccgatcataaccggtacttaattggagatgatgagcattgctggagtgaaaatggagtggcaaatattgaaggaggttgctatgcaaagtgtgtcgatctttcaaaggataaagaaccagacatctggaatgccatcaaatttgggacagtactcgaaaatgttgtttttgatgagcatactcgagag

SEQ ID NO: 6356 - DNA, 254 bp, Glycine max
  Clone ID: 700866163H1
aaggccccttcgccactgtttccgatgaggaacgccagagacagcaactccaatcaatcagtgcgtcgttggcgtcgttgacgagggtggcagggcctaaggtggtgaaaggagacccagccactaaggcagagaaggggacacatgttcatcaccatccgcaaccacattactttgcttcagcggcgtttgatgtcagtgacagtgcgctaaattcacccacgtcctctacaatctctcccccgctgagctgt

SEQ ID NO: 6357 - DNA, 250 bp, Glycine max
  Clone ID: 700868677H1
ttttacttaaattgcagtggtctgacaagaaggcctatcaagatacacgcttgaaactagcaagcttattcaagaagaattttgatggattcacgacctacaagataggaggggatcagaagttgactgaagagattgtctctgctggtcctatattctgatgagagcatttcctatttagcgaaaaaaaaaatgaagtccaaaagcattcggttgattatttctacttaaaggttttcactgtatttag

SEQ ID NO: 6358 - DNA, 277 bp, Glycine max
  Clone ID: 700943040H1
gcttcaacggcgtttgatgtcagtgacagtgcgctcaaattcacccacgtcctctacaatctctcccccgctgagctgtatgagcaagcgattaagcacgagaaaggatcattcataacggcaacgggagcgttagctacactttctggagcaaaaacgggacgctctccccgagacaaacgggttgtcagggacgacaccaccgagcatgacctctggtggggaaagggctcgcccaatattgaaatggacgaacataccttcttaatcaacagag

SEQ ID NO: 6359 - DNA, 270 bp, Glycine max
  unsure (1)...(270): unsure at all n locations
  Clone ID: 700972225H1
ccctatttatgcacaatatgtgcatccgacccactcctgaagagctagaggaatttggaactccagacttcactatatacaatgcaggacagttcccttgtaatcgttacacacactacatgacttcatcaactagtattgacatcaacattgcaaggaaagaaatggtcatcctggcacacaatatgctggggnatgaagaaaggtctctttggtttatgcactacctcatgcccaagcgcaatattctctccctnacattcgggtgca

SEQ ID NO: 6360 - DNA, 238 bp, Glycine max
  unsure (1)...(238): unsure at all n locations
  Clone ID: 700996224H1
tgaaaactaaggaataatttaccattgccaacagtactagttgcaattgtttctctcttcttccttcaatccagacaaaagagctgganaattttggtactccggacttcactatatacaatgctggacagttcccctgtaatcgttatactcactacatgacatcctccactagtatagatcttaatcttgctaggagggaaatggtcatcctcggcacacaatacgccggggaaat

SEQ ID NO: 6361 - DNA, 283 bp, Glycine max
  Clone ID: 701045039H1
gcacaacatgtaccggaaagaccactctttcgaccgatcacaataggtatctaatcggagatgatgaacactgttggggtgacaatggtgtctccaacattgaaggtggttgctatgccaaatgcattgacctctcacgggagaaagagccagatatttggaatgcaatcaggtttggcacagattgccagtgttggaaaacgtggtgttttgatgagcacgaccgagaagttgattactctgacaaatcagttacagaaaatactcgtgctgcttatcctat

SEQ ID NO: 6362 - DNA, 282 bp, Glycine max
  unsure (1)...(282): unsure at all n locations
  Clone ID: 700605402H2
gccaagacgggtcgctctccaagggacaagcgcgtcgtcaaggatgatcttactaagaacgacctttggtggggaaagggttctcctaacatcgagatggacgagcacagtttcatggtgaacagagaaagagctgttgattacttgaactccttggacaaggtcttcgtcaatgaccaattcttgaattgggacacagagaacagaatcaaagtccggattgtatctgccagagcttaccattcattgttcatgcacaacatgtgtatccgcnccactcct

SEQ ID NO: 6363 - DNA, 254 bp, Glycine max
  Clone ID: 700888213H1
cgagggtcgctctccaagggacaagcgcgtcgtcaaggatgatcttactaagaacgacctttggtggggaaagggttctcctaacatcgagatggacgagcacagtttcatggtgaacagagaaagagctgttgttacttgaactccttggacaaggtcttcgtcaatgaccaattcttgaattgggacacagagaacagaatcaaagtccggattgtatctgccagagcttaccattcattgttcatgcacaa

SEQ ID NO: 6364 - DNA, 298 bp, Glycine max
  Clone ID: 701040204H1
tggtcatcctcggcacacaatacgccggggaaatgaagaagggtcttttcggtgtcatgcattatctcatgcctaagcgccaaatcctctccctacactctggatgcaatatgggcaaagatggggatgtggcactcttctttggactctcaggtaccggaaagaccactctttcgaccgatcacaataggtatctaatcggagatgatgaacactgttggggtgacaatggtgtctccaacattgaaggtggttgctatgccaaatgcattgacctctcacgggagaaagagccaga

SEQ ID NO: 6365 - DNA, 260 bp, Glycine max
  Clone ID: 701042078H1
tggtcatcctcggcacacaatacgccggggaaatgaagaagggtcttttcggtgtcatgcattatctcatgcctaagcgccaaatcctctccctacactctggatgcaatatgggcaaagatggggatgtggcactcttctttggactctcaggtaccggaaagaccactctttcgaccgatcacaataggtatctaatcggagatgatgaacactgttggggtgacaatggtgtctccaacattgaaggttgttgctat

SEQ ID NO: 6366 - DNA, 259 bp, Glycine max
  Clone ID: 700849715H1
cctctccctacactccggatgcaatatgggcaaagatggggatgtggcactcttctttggactctcaggtactgggaagaccactctttccaccgatcacaataggtatttaatcggagatgatgaacactgttggggtgacaatggtgtctccaacattgaaggtggttgctatgccaaatgcattgacctctcacgggagaaagagccagtatttggaatgcaatcaggtttggcacagtgttggaaaatgtggtgt

SEQ ID NO: 6367 - DNA, 255 bp, Glycine max
  Clone ID: 700959272H1
attaggctttcacaacacctcagcgtcactgtaccagttggaaatggagacaataacagagaacggatcagatggtgtgagtttggcaagaaatacatccaacaacgcccgtcgagggttgccaatgatccaaacaaacatgaagccaacggattcggaattccaagtgtgccacgacgacagcaccccgccggtcagagcccaaaccattcacgagctccattctctgcagaagaaaaagtcaaccccttccac

SEQ ID NO: 6368 - DNA, 232 bp, Glycine max
  Clone ID: 700961793H1
tgcattaggctttcacaacacctcagcgtcactgtaccagttggaaatggagacaataacagagaacggatcagatggtgtgagtttggcaagaaatacatccaacaacgcccgtcgagggttgccaatgatccaaacaaacatgaagccaacggattcggaattccaagtgtgccacgacgacagcaccccgccggtcatagcccataccattcacgagctccattctctg

SEQ ID NO: 6369 - DNA, 242 bp, Glycine max
  Clone ID: 700726640H1
gagaactcaagaaatggagagaaacacagagaatggatcagatagtagtgtgagtttgaggagaaatacatctaacaatgggcgtcgagggttgccaatgagccaaacggattccgaagtgtgccacgacgacagcacccctctcagcaacaccaatccatcaggtttacgtgaatgatcaatttctgaattgggatccagaacacagaatcaaagtccgaatagtatctgcaagagcttat

SEQ ID NO: 6370 - DNA, 278 bp, Glycine max
  Clone ID: 700605382H2
ggcacagaagaaggtattaaggagcctcaggcaactttttcagcttgttttggtgcagcattcattatgctacaccctacaaagtatgcagcaatgcttgctgaaaagatgcagaagcatggtgctactggatggcttgttaacactggttggtctgctggaagctatggtaatggaagccgtattaaactacaatacacaaggaaaatcattgatgctattcactccggaagtctcctgaatgcagagtacaagaagactgaaatttttgggcttga

SEQ ID NO: 6371 - DNA, 260 bp, Glycine max
  Clone ID: 701052653H1
cacccgttagcaagctaaacctggcacagaccatgtaccatttcatcagtggatatactgctttggtggctggcacagaagaaggtattaaggagcctcaggcaactttttcagcttgttttggtgcagcattcattatgctacaccctacaaagtatgcagcaatgcttgctgaaaagatgcagaagcatggtgctactggatggcttgttaacactggttggtctgctggaagctatggtaatggaagccgtattaaa

SEQ ID NO: 6372 - DNA, 258 bp, Glycine max
  Clone ID: 700847843H1
cagggtggttgctatgccaaatgcattgacctctcacgggagaaagagccagatatttggaatgcaatcaggtttggcacagtgttggaaaacgtggtgtttgatgagcacgaccgagaagttgattactctgaaaatccagttacagaaaatactcgtgcctgcttatcctatagagtacattccaaatgcaaagttaccttgcgttggccctcatccaaagaatgtcatacttttggcatgtgacgcatttggggt

SEQ ID NO: 6373 - DNA, 261 bp, Glycine max
  Clone ID: 701051337H1
atttggaatgcaatcaggtttggcacagattcattttgattttttatttttctttcaattgattgccagtgttggaaaatgtggtgtttgatgagcatgatcgagaagttgattactctgacaagtcagttacagaaaatactcgtgcagcttatcctatagagtacattccaaatgcaaagttaccttgtgttggccctcacccaaagaatgtcatacttttggcatgtgacgcatttggtgtactcccacccgttagca

SEQ ID NO: 6374 - DNA, 280 bp, Glycine max
  unsure (1)...(280): unsure at all n locations
  Clone ID: 700656509H1
ctanaaagtatgcagcaatgcttggctgaaaagatncagaagcatggtgctactggatggcttgttaacactggttggtctnctggaagctatggtaatggaagccgtattaaactacaatacacaaggaaaatcattgatgctattcactccggaagtctcctgaatgcagagtacaagaagactgaaatttttgggcttgagattcccaccgaagtggagggtgtcccttcagaaattctggatcctatgaacacttggtcaaacaaaaaggcctacg

SEQ ID NO: 6375 - DNA, 228 bp, Glycine max
  Clone ID: 701101473H1
actcgagccgaatcggctcgagatcgagaagttgattactctgacaactcagttacagaaaataactcgtgcagcttatcctatacagtacattccaaatgcaaagttaccttgtgttggccctcacccaaagaatgtcatacttttggcatgtgacgcatttggtgtactcccacccgttagcaagctaaacctggcacagaccatgtaccatttcatcagtggata

SEQ ID NO: 6376 - DNA, 239 bp, Glycine max
  Clone ID: 701053551H1
cgaagtggagggtgtcccttcagaaattctagaccctgtgaacacttggtcaaacaaaaagggctacaaggagacactattgaagttggctggattgttcaagaacaattttgaaaccttcaccaactacaagattggcaagggcaacaacaacctgacagaagagattctcgcagctggtccaatcttttgagacaatgttatgtaacatgttgtgtggttgggaatgttaatgttag

SEQ ID NO: 6377 - DNA, 255 bp, Glycine max
  Clone ID: 701046671H1
gaacgtcataagcaacaactccagtccatcagtgcatccctggcatcactgactagagaaactggaccgaatctggtgaagggagacccagctcggaagtcagatacccagaaggttactcacgtgcaccaccatcatgtcagtactcccaccattgctgtcagcgacagtgctttgaaatttactcatgtcctctacaatctctccccagctgaactttatgaacaggcgattaagtatgagaaaggatcgttc

SEQ ID NO: 6378 - DNA, 241 bp, Glycine max
  Clone ID: 701103555H1
ccctcaccgaagaagaacgtcataagcaacaactccaatccatcagtgcatctctggcatcactgaccagagaaactggaccgaaactggtgaagggagacccagctaggaagtcagatacccagaaggttactcacgtgcaccatcatgtcagcactcccaccattgttgtcagcgacagttctttgaaatttacccatgtcctctacaatctctccccagctgaactttatgaacaagc

SEQ ID NO: 6379 - DNA, 422 bp, Glycine max
  unsure (1)...(422): unsure at all n locations
  Clone ID: LIB3056-013-Q1-N1-F3
caatgtcccatttcatcagtggctacacagccctggttgctgggacagaggatggtataaaagaaccacaggctacattctctgcttgtttcggggcagcgtttataatgatgcaccctaccaaatatgcagcaatgctagccgaaaagatgcagaagcatggggctactggatggcttgtcaatactggctggtcaggaggaagttatggattaggcaatcggattaagttagcgtatactaggaaaatcatngatgctattcactctgggagccttttgaatgcacagtacactaagactgaagtgtttgggcttgagatcccaacagcactaaaaggagtcccttctgaaatcttggaccctgtgaatacttggtctgacaagaaggcctatcaagatacacgcttgaaactagcaagc

SEQ ID NO: 6380 - DNA, 325 bp, Glycine max
  Clone ID: LIB3051-054-Q1-K1-G11
gggccgacccactcgtccgcgctggttccctttctaaagccctcgcattcacgtccgtcgtcccgagcaggacgcgcgagctgcctagaaggcgacgccaaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgtcgacgcgatcagcgaggaggagcgccac

SEQ ID NO: 6381 - DNA, 440 bp, Glycine max
  Clone ID: LIB3051-063-Q1-K1-D7
ggccccccgccagataagtgccctatcgttgaaagccttaattaatttatacatataatggggtacataatatacatacatccctgatgaaagtggaggaaaaggttccctccaaaatagtgcatgctagtttagtttagtgtacaaagtggataactgggtgggtgacaggtgtatccgccccactcctgaagagctggagaattttggtactccggacttcactatatacaatgctggacagttcccctgtaatcgttatactcactacatgacatcctccactagtatagatcttaatcttgctaggagggaaatggtcatcctcggcacacaatacgccggggaaatgaagaagggtcttttcggtgtcatgcattatctcatgcctaagcgccaaatcctctccctacactctggatgcaatatgggcaaagatg

SEQ ID NO: 6382 - DNA, 433 bp, Glycine max
  Clone ID: LIB3051-065-Q1-K1-G9
ctcgtttcgtcttcacacttgcaacgcaacaacgtaacgttgctaattgcttgcacttcgcatggtcgcttcttttgtttcacattagctgtttttgtttttgtcttagttttacacctttcctcatttccgcagtagcaacctgcgaatcaacctctctgagaaaaaaaatggcgtcgaacgggaatggcagcgttgcgaacggtaacgggagcgctaggaacggacttgcgaagattcagacgcagaagaagcatgacgggatttgtcacgacgacagcggtccaacggtgaaggctcagaccattgacgagcttcactcgctgcagaagaagaaatccgcacccaccacccccgttacggggtttcaggctcctttcgccaccctcaccgaagaagaacgtcataagcaacaactccaatccatcagtgc

SEQ ID NO: 6383 - DNA, 324 bp, Glycine max
  Clone ID: LIB3051-003-Q1-E1-C4
aaaggatcattcatcacttcaaccggggcattggcaacactttctggggccaagacaggtcgctctccaagggacaagcgcgtcgtcaaggatgatcttactgagaacgagctttggtggggaaagggttcccctaacatcgagatggacgaacacactttcatggtgaacagagaaagagctgttgattacttgaactcgttggacaaggtcttcgtcaacgaccaattcttgaattgggacacagagaacagaatcaaagtccggattgtctctgccagagcttaccattcagtggtcagtcacaacatgtaattgaaaact

SEQ ID NO: 6384 - DNA, 444 bp, Glycine max
  Clone ID: LIB3051-104-Q1-K1-G11
gcgttcgccacgcgttcttaaaatgtggtgtttgatgagcatgatcgagaagttgattacgctgacgtgtcagggacagagggtactcgtgcagcttatcctatagagtacattccaaatgcaaagttaccttgtgttggccctcacccaaagaatgtcatacttttggcatgtgacgcatttggtgtactcccacccgttagcaagctaaacctggcacagaccatgtaccatttcatcagtggatatactgctttggtggctggcacagaagaaggtattaaggagcctcaggcaactttttcagcttgttttggtgcagcattcattatgctacaccctacaaagtatgcagcaatgcttgctgaaaagatgcagaagcatggtgctactggatggcttgttaacactgggtggtctgctggaagctatggtaatggaagc

SEQ ID NO: 6385 - DNA, 363 bp, Glycine max
  Clone ID: LIB3051-042-Q1-K1-C1
ctcttttttactattgtttgttttaggtactgggaagaccactctttccaccgatcgcaatatgtagttaatcggagatgatgaacactgttggggtgacaatggtgtctccaacattgaaggtggttgctatgccaaatgcattgacctctcacgggagaaagagccagatatttggaatgcaatcaggtttggcacagtgttggaaaatgtggtgtttgatgagcatgatcgagaagttgattactctgacaagtcagttacagaaaatactcgtgcagcttattctatagagtacattccaaatgcaaagttaccttgtgttgggccttacccaaagaatgtcatacttttggcatgtga

SEQ ID NO: 6386 - DNA, 417 bp, Glycine max
  Clone ID: LIB3051-116-Q1-K1-B4
cccacgcgtccgggcgggcacagaagataggtattaaggagcctcaggcaactttttcagcttgttttggtgcagcattcattatgctacaccctacaaagtatgcagcaatgcttgctgaaaagatgcagaagcatggtgctaccggatggcttgtcaacactggttggtctgctggcagctatggctatggaagtcgcattaaactacaatacacaagaaaaatcattgatgctattcactcaggaagtctgctgaatgcagagtacaagaagactgaaatttttgggcttgagatccccaccgaagtggacggtgtcccttcagaaattctagaccctgtgaacacttggtcaaacaaaaagggctacaaggagacactattgaaattggctggattgttcaagaacaattttg

SEQ ID NO: 6387 - DNA, 405 bp, Glycine max
  Clone ID: LIB3051-046-Q1-K1-E11
cagaagcatggtgctactggatggcttgttaacactggttggtctgctggaagctatggtaatggaagccgtattaaactacaatacacaaggaaaatcattgatgctattcactccggaagtctcctgaatgcagagtacaagaagactgaaatttttgggcttgagattcccaccgaagtggagggtgtcccttcagaaattctggatcctatgaacacttggtcaaacaaaaaggcctacaaggagacactattgaagttggctggattgttcaagaacaattttgaaaccttcaccaactacaagattggcaagggaaacaacaacctgacagaagagattctcgcagctggtccaatcttttgagacaatgttatgcaacatgttgtgtggttgggaatg

SEQ ID NO: 6388 - DNA, 270 bp, Glycine max
  Clone ID: 700868431H1
cactattgaagttggctggattgttcaagaacaattttgaaaccttcaccaactacaagattggcaagggcaacaacaacctgacagaagagattctcgcagctggtccaatcttttgagacaatcgttatgtaacatgttgtgtggttgggaatgttaatgttaggatggtagataaaatcttgccttagaataaaatattgtaccattggtttggttgggctcataatgtcatttctattcttcctccaaaaaaatgaagtttatttt

SEQ ID NO: 6389 - DNA, 89 bp, Zea mays
  unsure (1)...(89): unsure at all n locations
  Clone ID: 700044189H1
gtgctgcgcgaacgtgcgtggatgtcgctgaatgggtcgactggtgaggtgatggttgggaagcagncggtttgtctaccagcgcttag

SEQ ID NO: 6390 - DNA, 308 bp, Zea mays
  Clone ID: 700098830H1
gacgccgcgccgatacagacgaccaaaaagagggtgttccacttcggcaagggccagaaccgagggaacaagaccatgaagaactgctgggcggcaagggcgcgaacctggcggagatggcgagcatcgggctgtcggtgccgccggggttcacggtgtcgacggaggcgtgccagcagtaccaggacgccgggtgcgccctccccgcggggctctgggccgagatcgtcgacggcctgcagtgggtggaggagtacatgggcgccaccctgggcgatccgcagcgcccgctcctgctctccgtccgc

SEQ ID NO: 6391 - DNA, 285 bp, Zea mays
  Clone ID: 700267212H1
cagaaagaagtggcatgacctcccatgccgccgtggtcgcacgcaggtggggaaaatgctgtgtctcgggatgctctgggattcgtgtaaatgacgcagagaaggttgtgaagattggaggcaatgtgctgcgcgaaggtgagtggctatcgctgaatggatcgaccggcgaagtgatcctcggaaagcagccgctctccccaccagccctcagtggcgatctgggaacattcatgtcctgggtggatgacgttagaaagctcaaggtcctggcaaacgcggata

SEQ ID NO: 6392 - DNA, 195 bp, Zea mays
  Clone ID: 700268101H1
cgcccgttgttgtatcttgtcactgatcagtgttgtttgctttgctttgccgtgctaatggcgcacgctccatgtggccgttcgtcgcagagggtgttccacttcggcaagggcaagagcgagggcaacaagaacatgaaggagctggtgagagggtcctacttctgtattcaattcgcttgctttgctactgca

SEQ ID NO: 6393 - DNA, 221 bp, Zea mays
  Clone ID: 700404827H1
ctcaccttttcgctgtactcactcgccacacacaccccctctccagctccgttggaactccggacaacagcaggcgcggggcggtcacgtagtaagcagctctcggctccctctccccttgctccatatgatcgtgcaacccatcgagctacgcgcgtggactgccttccctgggtccgcgcaggaggggatcggagagatgacggcatccgtttccaggg

SEQ ID NO: 6394 - DNA, 105 bp, Zea mays
  Clone ID: 700426407H1
gggccagactctcgggtacaaagttggaacaatgattgagctacccagggcaggtactagtggctgatgagatagcggagcaggctgcattcttctcctgcggaa

SEQ ID NO: 6395 - DNA, 99 bp, Zea mays
  Clone ID: 700430716H1
gctcataaaagctacaatcccatctcccttttttttccagtctagtaaaagttccaaactgctgggggttcaaaactctgttcttcaatacatcatcaa

SEQ ID NO: 6396 - DNA, 167 bp, Zea mays
  Clone ID: 700438208H1
cgtgggtgggggaaatgctgcgtctcgggatgctcaggcattcgcgtaaacgatgcggagaagctcggaggccatgtgctgcgcgaaggtgagtggctgtcgctgaatgggtcgactggtgaggtgatctttcatagcctgggtggatgatgttagaaagctcgcga

SEQ ID NO: 6397 - DNA, 197 bp, Zea mays
  Clone ID: 700438250H1
cgaacaagcgcgcgcgtacgtgagctcagccttcgacacaaagcacgagacaatggggcacaaggcattgggttatgccggacagagcacatgttctttgcttgcttaaggctgtcaggcagatgattatggctcccacgcttgagctgaggcagcagacgctcgaagataaatcccggtgaacatccgactcctgg

SEQ ID NO: 6398 - DNA, 247 bp, Zea mays
  Clone ID: 700442440H1
aatgaccaaccagggtgttcaagtgttcccagagataatggttactcttgttggaacaccacaggaactggggcatcaagtgactcttagccgccaagttgctgagaaagtgttcgccaatgtgggcaagactatagggtacaaagttggaacaaggttaagacccagggggcatctctggggctgatgagaatgcgggaaaggcgaattcttctccttcggaacaaacgacctgacgcagatgacc

SEQ ID NO: 6399 - DNA, 249 bp, Zea mays
  Clone ID: 700442486H1
ctatcgggtacaaagttggaacaatgatgtgtgatccccatgggggttcttgtggctgattatatagcggacatgctgaattcttctccttcggaacgaacgaccttactcagatgatctttgggtacagcatggatgatgtgggaaagttcaatcccgtctatcatgctcagtggattcgccgaatggagccctttcaggtcttggtcagtagtggattggcgagctgttaagctttctacagatagg

SEQ ID NO: 6400 - DNA, 117 bp, Zea mays
  Clone ID: 700442534H1
cacagatcaagtcagtgacactggtctgccagcctcacctagggctgctgtaggccacgttgtgtttactgctgacgatgctgaagcatggcattctcaagggaaagctgctattct

SEQ ID NO: 6401 - DNA, 194 bp, Zea mays
  Clone ID: 700445755H1
agttcctcttgttagaacaccacaggaactggggcatcaagtgactcttatccgccaagttgctgagaaagtgttcgccaatgtgggcaagactatcgggtacaaagttggaccaatgattgatatccccagggcagctctggtggctgatgagatagcggagcgggctgaattcggctccttcggaacgaacg

SEQ ID NO: 6402 - DNA, 158 bp, Zea mays
  Clone ID: 700448312H1
cggctcgagcgacaagccctacgggattgggggtcttgatcttcttcttggagcagacgacagcgaaggaggatgcgcggaaatgctgcgtctcgggatgcacaggcattcgcgtaaacgatgcggagaagctcgtgacgatcggaggccatgtgctt

SEQ ID NO: 6403 - DNA, 162 bp, Zea mays
  Clone ID: 700458259H1
cgactggtgaggtgatccttgggaagcagccgctttccccaccagcccttagtggtgatctgggaactttcatggcctgggtggatgatgttagaaagctcaaggtcctggataacgccgatacccctgataatgcattgactccgcgaaacaatggggaca

SEQ ID NO: 6404 - DNA, 123 bp, Zea mays
  Clone ID: 700460850H1
aagagactgggacatcaagtgactcttatccgccgagttgcggataaagtgttgcgccaaggtgtgcaatactatcgggtacaaagtttggtctatgattgagctccccagggcaactctggt

SEQ ID NO: 6405 - DNA, 191 bp, Zea mays
  Clone ID: 700576979H1
gtacaggctaaagtgccgtggaagatgcgccgtagaatcggttaacgagggccttgtatgagcccgctcagcggtcgagattgtagagacatgccacctggaccagcttctccatcctcagtttgacgacccgtcggcgtacaaggatcaagtcattgccactggtctgccagcctcacctggggctgctg

SEQ ID NO: 6406 - DNA, 249 bp, Zea mays
  Clone ID: 700582461H1
cagttgccgtgctatggattgactcccggtgaccatccgactcctggatcctcggctcgacgagtgccttgcagaagggcacatcgacgacattggtaagtgagttatttgctgagactggagctaagcagtaggaggctctgacgctaattgaaaatgtgttagaagttagcgcgatgcttggcttccgtgggtgcaggcttggtatatcgtagcctgaattgacagagatgcaggcccgtgccattt

SEQ ID NO: 6407 - DNA, 244 bp, Zea mays
  Clone ID: 700613790H1
atcgaatttactgttcaggagagcaggctgtggatgttgcagtgcaggacagggaaacgtacgggcaaaagcgccgtaaagatcgccgtggacatggttaacgagggccttgttgagcgccgtgcggcgatcaagatggtagagccaggccacctggaccagcttctccatcctcagtttgagaacccatcggcgtacaaggaccaagtcattgccacgggcctaccggcgtcaccttgggccg

SEQ ID NO: 6408 - DNA, 308 bp, Zea mays
  Clone ID: 700615033H1
gaacccggaggatcttgatgccatgaaggacgttatgccacaggcctacaaagagctagtcgagaactgcaggatactggagagcactataaagaaatgcaggacatcgaatttactgttcaggagagcaggctgtggatgttgcagtgcaggacagggaaacgtacgggcaaaagcgccgtaaagatcgccgtggacatggttaacgagggccttgttgagcgccgtgcggcgatcaagatggtagagccaggccacctggaccagcttctccatcctcagtttgagaacccatcggcgtacaagga

SEQ ID NO: 6409 - DNA, 272 bp, Zea mays
  Clone ID: 700807115H1
ggcattcccaagggaaatcagttatgctggtgagggcggagaccagccctgaggacgtcggcggcatgcacgcggctgcaggaatcctcacagaaagaggtggcatgacctcccatgccgccgtggtcgcacgcgggtggggaaaatgctgtgtctcgggatgctctgggattcgtgtaaatgacgcagagaaggttgtgaagattggaggcaatgtgctgcgcgaaggtgagtggctatcgctgaatggatcgaccggcgaagtgatcctc

SEQ ID NO: 6410 - DNA, 275 bp, Zea mays
  Clone ID: 700807148H1
cgctagcgcactaccgccgtacagatcgccgtggacatggttaacgagggccttgttgagcgccgtgcggcgatcatgatggtagagccaggccacctggaccagcttctccatcctcagtttgagaacccatcggcgtacaaggaccaagtcattgccacgggcctaccggcgtcacctggggccgctgtgggccaggttgtattcactgctgaggacgctgaaacatggcattcccaagggacatcagatattctggtgagggcggataccag

SEQ ID NO: 6411 - DNA, 258 bp, Zea mays
  Clone ID: 700807285H1
gctgaagatcgacaccgacatgaccgccaacgacctcatagagctggtgggacagtacaaggacgtctacgtggaggctaagggagagccattcccctcagacaccaagaggcagctgaagttggcagtgctggccgtgtacgactcgtgggagagcacgagggcaaagaagtacaggagcatcatccagaaaaccggcctcaggggcaccgccgtgaccgtgcagtgcatggtgttcggaaacatggggcaccctct

SEQ ID NO: 6412 - DNA, 355 bp, Zea mays
  Clone ID: 700616008H1
aaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcggagaccagccctgaggacgttggtggcatgcacgctgctgtggggattcttacagagaggggtggcatgacttcccacgctgctgtggtcgcacgtgg

SEQ ID NO: 6413 - DNA, 341 bp, Zea mays
  Clone ID: 700084360H1
acgggagcctaacaggaggatgccctcgcgcgagttgaaaagctttcagaagtaaacccgatgcttggcttccgtgggtgcaggcttggtatatcgtagcctgaattgacagagatgcaagcccggggcatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatcccagggcagctctggtggctgatgag

SEQ ID NO: 6414 - DNA, 327 bp, Zea mays
  Clone ID: 700097569H1
gttcggcaacgtcgtcatggacatcccccgctcactgttcgaagagaagcttgagcacatgaaggaatccaaggggctgaagaacgacaccgacctcacggcctctgacctcaaagagctcgtgggtcagtacaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggaa

SEQ ID NO: 6415 - DNA, 332 bp, Zea mays
  Clone ID: 700099686H1
ctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctccttcgga

SEQ ID NO: 6416 - DNA, 332 bp, Zea mays
  Clone ID: 700097065H1
aaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctcct

SEQ ID NO: 6417 - DNA, 322 bp, Zea mays
  Clone ID: 700097577H1
caggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagat

SEQ ID NO: 6418 - DNA, 319 bp, Zea mays
  Clone ID: 700098157H1
ggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggct

SEQ ID NO: 6419 - DNA, 321 bp, Zea mays
  Clone ID: 700095354H1
gcgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatgg

SEQ ID NO: 6420 - DNA, 319 bp, Zea mays
  Clone ID: 700097024H1
ctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctga

SEQ ID NO: 6421 - DNA, 317 bp, Zea mays
  Clone ID: 700101705H1
ccgccgtgaacgtgcagtgcatggtgttcggcaacatggggaacacttctggcaccggcgtgctcttcactaggaaccccaacaccggagagaagaagctgtatggcgagttcctggtgaacgctcagggtgaagatgtggttgccggaataagaaccccagaggaccttgacgccatgaagaacctcatgccacaggcctacgacgagcttgttgagaactgcaacatcctggagagccactataaggaaatgcaggatatcgagttcactgtccaggaaaacaggctgtggatgttgcagtgcaggacagggaaa

SEQ ID NO: 6422 - DNA, 320 bp, Zea mays
  Clone ID: 700100753H1
cgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggc

SEQ ID NO: 6423 - DNA, 325 bp, Zea mays
  Clone ID: 700209526H1
cggacgcgtggtggctgatgagatagcggacaggctgaattcttctccttcggaacgaacgacctgacgacagatgacctttgggtacagcagggatgatgtggggaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcctctgtggccttcttcgcgagagctgggctggattacgtttcttgctcccct

SEQ ID NO: 6424 - DNA, 308 bp, Zea mays
  Clone ID: 700101967H1
aggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaag

SEQ ID NO: 6425 - DNA, 320 bp, Zea mays
  Clone ID: 700100971H1
gccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggc

SEQ ID NO: 6426 - DNA, 318 bp, Zea mays
  Clone ID: 700097028H1
gttcggcaacatggggaacacttctggcaccggcgtgctcttcaccaggaaccccaacaccggagagaagaagctgtatggcgagttcctggtgaacgctcagggtgaggatgtggttgccggaataagaaccccagaggaccttgacgccatgaagaacctcatgccacaggcctacgacgagcttgttgagaactgcaacatcctggagagccactacaaggaaatgcaggatatcgagttcactgtccaggaaaacaggctgtggatgttgcagtgcaggacagggaaacgtacgggcataagtgccgtgaagat

SEQ ID NO: 6427 - DNA, 323 bp, Zea mays
  Clone ID: 700100216H1
tgctgaggatgctgaagcatggcattcccaagggaaagctgctattctggtaagggcggagaccagccctgaggacgttggtggcatgcacgctgctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttggaaagcagccgctttccccaccagccctta

SEQ ID NO: 6428 - DNA, 316 bp, Zea mays
  Clone ID: 700100408H1
ggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacga

SEQ ID NO: 6429 - DNA, 306 bp, Zea mays
  Clone ID: 700098443H1
gatgctcaggcattcgcgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgaga

SEQ ID NO: 6430 - DNA, 313 bp, Zea mays
  Clone ID: 700099779H1
gtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaaggga

SEQ ID NO: 6431 - DNA, 306 bp, Zea mays
  Clone ID: 700099086H1
gggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatg

SEQ ID NO: 6432 - DNA, 303 bp, Zea mays
  Clone ID: 700101887H1
gacctcacggcctctgacctcaaagagctcgtgggtcagtacaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcactaggaaccccaacaccggagagaagaagctgtatggcgag

SEQ ID NO: 6433 - DNA, 304 bp, Zea mays
  Clone ID: 700097164H1
ggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgatt

SEQ ID NO: 6434 - DNA, 323 bp, Zea mays
  Clone ID: 700100751H1
ggcaaaagtgccgtgaagatcgccgtggacatggttaacgagggccttgttgagccccgctcagcgatcaagatggtagagccaggccacctggaccagcttctccatcctcagtttgagaacccgtccgcgtacaaggatcaagtcattgccactggtctgccagcctcacctggggctgctgtgggccaggttgtgttcactgctgaggatgctgaagcatggcattccccagggaaagctgctattctggtaagggcagagaccagccctgaggacgttggtggcatgcacgcagctgtgggggatcttacagagagggg

SEQ ID NO: 6435 - DNA, 301 bp, Zea mays
  Clone ID: 700101890H1
cagctgtggatgttgcagtgcaggacagggaaacgtacgggcaaaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcag

SEQ ID NO: 6436 - DNA, 325 bp, Zea mays
  Clone ID: 700100212H1
cccacgcgtccgtgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctcca

SEQ ID NO: 6437 - DNA, 300 bp, Zea mays
  Clone ID: 700100040H1
aaagagctcgtgggtcagtacaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcactaggaaccccaacaccggagagaagaagctgtatggcgagttcctggtgaacgctcag

SEQ ID NO: 6438 - DNA, 297 bp, Zea mays
  Clone ID: 700101179H1
atccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaa

SEQ ID NO: 6439 - DNA, 326 bp, Zea mays
  Clone ID: 700097777H1
cggacgcgtgggctgacgcagatgacctttgggtacagcagggatgatgtggggaagttcattcccgtctatcttgctcagggcatcctccaacatgaccccatcgaggtcctggaccagaggggagtgggcgagctggtgaagtttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctg

SEQ ID NO: 6440 - DNA, 319 bp, Zea mays
  Clone ID: 700621494H1
cggtggagagccttcctctgttgccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaatta

SEQ ID NO: 6441 - DNA, 314 bp, Zea mays
  Clone ID: 700621492H1
cggtggagagccttcctctgttgccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaatctgttcttcaatacatcatca

SEQ ID NO: 6442 - DNA, 335 bp, Zea mays
  Clone ID: 700620055H1
ctcacatgacccttcgaggtcctggaccagaggggagtgggcgagctggtgaagcttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgct

SEQ ID NO: 6443 - DNA, 294 bp, Zea mays
  Clone ID: 700099278H1
gtgccagcagtaccaggacgccgggtgcgccctccccgcggggctctgggccgagatcgtcgacggcctgcagtgggtggaggagtacatgggcgccaccctgggcgatccgcagcgcccgctcctgctctccgtccgctccggcgccgccgtgtccatgcccggcatgatggacacggtgctcaacctggggctcaacgacgaagtcgccgccgggctggcggccaagagcggggagcgcttcgcctacgactccttccgccgcttcctcgacatgttcggcaacgtcgtcat

SEQ ID NO: 6444 - DNA, 314 bp, Zea mays
  Clone ID: 700100235H1
ccatgaagaacctcatgccacaggcctacgacgagcttgttgagaactgcaacatcctggagagccactacaaggaaatgcaggatatcgagttcactgtccaggaaacaggctgtggatgttgcagtgcaggacagggaaacgtacgggcaaaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccag

SEQ ID NO: 6445 - DNA, 306 bp, Zea mays
  Clone ID: 700097726H1
cccacgcgtccgggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcggagaccagccctgaggacgttggtggcatgcacgctgctgtggggattcttacagagaggggtgg

SEQ ID NO: 6446 - DNA, 303 bp, Zea mays
  Clone ID: 700099458H1
ggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcg

SEQ ID NO: 6447 - DNA, 293 bp, Zea mays
  Clone ID: 700101405H1
gtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtg

SEQ ID NO: 6448 - DNA, 307 bp, Zea mays
  Clone ID: 700098006H1
cccacgcgtccggttcactgtccaggaaaacaggctgtggatgttgcagtgcaggacagggaaacgtacgggcaaaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatggcattcccaaggg

SEQ ID NO: 6449 - DNA, 296 bp, Zea mays
  Clone ID: 700098988H1
gaaggaactgctgggcggcaagggcgcgaacctggcggagatggcgagcatcgggctgtcggtgccgccggggttcacggtgtcgacggaggcgtgccagcagtaccaggacgccgggtgcgccctccccgcggggctctgggccgagatcgtcgacggcctgcagtgggtggaggagtacatgggcgccaccctgggcgatccgcagcgcccgctcctgctctccgtccgctccggcgccgccgtgtccatgtccggcatgatggacacggtgctcaacatggggctcaacgacg

SEQ ID NO: 6450 - DNA, 290 bp, Zea mays
  Clone ID: 700101193H1
cagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaa

SEQ ID NO: 6451 - DNA, 289 bp, Zea mays
  Clone ID: 700099029H1
gaagctgtatggcgagttcctggtgaacgctcagggtgaggatgtggttgccggaataagaaccccagaggaccttgacgccatgaagaacctcatgccacaggcctacgacgagcttgttgagaactgcaacatcctggagagccactacaaggaaatgcaggatatcgagttcactgtccaggaaaacaggctgtggatgttgcagtgcaggacagggaaacgtacgggcaaaagtgccgtgaagatcgccgtggacatggttaacgagggccttgttgagccccgc

SEQ ID NO: 6452 - DNA, 292 bp, Zea mays
  Clone ID: 700099494H1
gaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccgg

SEQ ID NO: 6453 - DNA, 342 bp, Zea mays
  Clone ID: 700624034H1
cttgctcagggcattctccaacatgaccccttcgaggtcctggaccagaggggagtgggcgagctggtgaagcttgctacagagaggggccgcaagctaggcctaattgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagt

SEQ ID NO: 6454 - DNA, 299 bp, Zea mays
  Clone ID: 700099587H1
gagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtg

SEQ ID NO: 6455 - DNA, 294 bp, Zea mays
  Clone ID: 700097537H1
cggcgtacaaggatcaagtcattgccactggtctgccagcctcacctggggctgctgtgggccaggttgtgttcactgctgaggatgctgaagcatggcattcccaagggaaagctgctattctggtaagggcagagaccagccctgaggacgttggtggcatgcacgcagctgtggggattcttacagagaggggtggcatgacttcccacgctgctgtggtcgcacgtcggtgggggaaatgctgcgtctcgggatgctcaggcattcgcgtaaacgatgcggagaagctcg

SEQ ID NO: 6456 - DNA, 296 bp, Zea mays
  Clone ID: 700099280H1
tgaggatgctgaagcatggcattcccaagggaaagctgctattctggtaagggcggagaccagccctgaggacgttggtggcatgcacgctgctgtggggattcttacagagaggggtggcatgacttcccacgctgctgtggtcgcacgtaggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttggaaagc

SEQ ID NO: 6457 - DNA, 302 bp, Zea mays
  Clone ID: 700099242H1
cgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagct

SEQ ID NO: 6458 - DNA, 312 bp, Zea mays
  Clone ID: 700097259H1
gagatccccagggcagctctggtggctgatgagatagcggacaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctctgtggccttcttcgcgaaggctgggc

SEQ ID NO: 6459 - DNA, 290 bp, Zea mays
  Clone ID: 700099789H1
gtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcatttttccgtgcaaggatggactcccggtgaccatccgactcctggaccctcccct

SEQ ID NO: 6460 - DNA, 324 bp, Zea mays
  unsure (1)...(324): unsure at all n locations
  Clone ID: 700097672H1
cggacgcgtgggcggacgcgtgggatgaaggaatccaaggggctgaagaacgacaccgacctcacggcctctgacctcaaagagctcgtgggtcagtacaaggaggatctacctctcaggcanaggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcactag

SEQ ID NO: 6461 - DNA, 299 bp, Zea mays
  Clone ID: 700099985H1
cccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtggggaagttcattcccgtctatcttgctcagggcatcctccaacatgacccctt

SEQ ID NO: 6462 - DNA, 281 bp, Zea mays
  Clone ID: 700045762H1
cttgagcacatgaaggaatccaaggggctgaagaacgacaccgacctcacggcctctgacctcaaagagctcgtgggtcagtacaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggaacac

SEQ ID NO: 6463 - DNA, 297 bp, Zea mays
  Clone ID: 700101542H1
gcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacagagctgaattcttctccttcggaacgaacgacctgacgcagatgacctttgggtacagcagggatgatgtggggaagttcattcccgtctat

SEQ ID NO: 6464 - DNA, 300 bp, Zea mays
  Clone ID: 700099788H1
ctggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgacgtctcttgccgtatcagaggtctga

SEQ ID NO: 6465 - DNA, 295 bp, Zea mays
  Clone ID: 700265183H1
ctgacgcagatgacctttgggtacagcagggatgatgtggggaagctcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcctctgtgcccttcttcgcgaaggctgggctggattacgtttcttgctcccctttcagggttccgattgctaggctagctgcagctc

SEQ ID NO: 6466 - DNA, 293 bp, Zea mays
  Clone ID: 700072495H1
gccagcctcacctggggctgctgtgggccaggttgtgttcactgctgaggatgctgaagcatggcattcccaagggaaagctgctattctggtaagggcagagaccagccctgaggacgttggtcgcatgcacgcagctgtggcgattcttacagagaggggtggcatgacttcccacgctgctgtggtcgcacgtcggtcggggaaatcctgcgtctcgggatgctcaggcattcgcgtaaacgatgcggagaagctcgtgacgatcggaggccatgtgctgcgcgaaggtg

SEQ ID NO: 6467 - DNA, 284 bp, Zea mays
  Clone ID: 700578123H1
catcaagtgactcttatccgtcaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtggggaagttcattcccgtctatcttgctcagggcatcctccaacatgaccccttcgaggtcctggaccagaggggagtgggcgag

SEQ ID NO: 6468 - DNA, 296 bp, Zea mays
  Clone ID: 700445628H1
ctggctaacgccgatacccctgatgatgcattgactgcgcgaaacaatggggcacaaggaattggactatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgagga

SEQ ID NO: 6469 - DNA, 299 bp, Zea mays
  Clone ID: 700098025H1
cggacggtgggggtttgctacagagaggggccgcaaagctaggcctaacttgaaggtgggcatttgtggagaacacggtggagagccttcctctgtggccttcatcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataa

SEQ ID NO: 6470 - DNA, 276 bp, Zea mays
  Clone ID: 700457276H1
gagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaaga

SEQ ID NO: 6471 - DNA, 277 bp, Zea mays
  Clone ID: 700045419H1
tttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccag

SEQ ID NO: 6472 - DNA, 279 bp, Zea mays
  Clone ID: 700457282H1
gagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagacta

SEQ ID NO: 6473 - DNA, 281 bp, Zea mays
  Clone ID: 700042861H1
ggcaaaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcggagaccagccctgaggacgt

SEQ ID NO: 6474 - DNA, 308 bp, Zea mays
  Clone ID: 700099765H1
cccacgcgtccgggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaagctttcagaagtaaacccgatgcttggcttccgtgggtgcaggcttgg

SEQ ID NO: 6475 - DNA, 277 bp, Zea mays
  Clone ID: 700213650H1
gcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttcc

SEQ ID NO: 6476 - DNA, 274 bp, Zea mays
  Clone ID: 700157249H1
caaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagact

SEQ ID NO: 6477 - DNA, 277 bp, Zea mays
  Clone ID: 700441931H1
caagaagcagctggagctagcagtgctggctgtgttcaactcgtgggagagccccagggccaagaagtacaggagcatcaaccagatcactggcctcaggagcaccgccgtgaacgtgcagtgcatggtgttcggcaacatggggaacacttctggcaccggcgtgctcttcactaggaaccccaacaccggagagaagaagctgtatggcgagttcctggtgaacgctcagggtgaggatgtggttgccggaataagaccccagaggaccttgacg

SEQ ID NO: 6478 - DNA, 297 bp, Zea mays
  Clone ID: 700097944H1
cccacgcgtccgatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcg

SEQ ID NO: 6479 - DNA, 292 bp, Zea mays
  Clone ID: 700423208H1
agccaaccaggaggatgccctcgcgcgaattgaaaagctttcagaagtaaacccgatgcttggcttccgtgggtgcaggcttggtatatcgtaccctgaattgacagagatccaagcccgggccatttttgaagctgctatagcaatgaccaaccagggtgttcaagtgttcccagagataatgttcctcttgttggaacaccacaggaactggggcatcaagtgactcttatccgccaagttgctgagaaagtgttcgccaatgtgggcaagactatcgggtacaaagttg

SEQ ID NO: 6480 - DNA, 286 bp, Zea mays
  Clone ID: 700442667H1
tgtgctgagacgggagccaaccaggaggatgccctcgcgcgaattgaaaagctttcagaagtaaacccgatgcttggcttccgtgggtgcaggcttggtatatcgtaccctgaattgacagagatgtcagcccgggccatttttgaagctgctatagcaatgaccaaccagggtgttcaagtgttcccagagataatggttcctcttgttggaacaccacaggaactggggcatcaagtgactcttatccgccatgttgctgagaaagtgttcgccaatgtgggca

SEQ ID NO: 6481 - DNA, 271 bp, Zea mays
  Clone ID: 700044521H1
ggctggcggccaagagcggggagcgcttcgcctacgactccttccgccgcttcctcgacatgttcggcaacgtcgtcatggacatcccccgctcactgttcgaagagaagcttgagcacatgaaggaatccaaggggctgaagaacgacaccgacctcacggcctctgacctcaaagagctcgtgggtcagtacaaggaggtctacctctcagccaagggagagccattcccctcagaccccaagaagcagctggagctagcagtgctggc

SEQ ID NO: 6482 - DNA, 307 bp, Zea mays
  Clone ID: 700208177H1
cggacgcgtggcgagacgcgtgggtgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgc

SEQ ID NO: 6483 - DNA, 291 bp, Zea mays
  Clone ID: 700444555H1
ggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtggggaagttcattcccgtctatcttgctcagggcatcctccaacatgaccccttcga

SEQ ID NO: 6484 - DNA, 290 bp, Zea mays
  Clone ID: 700580211H1
ggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgct

SEQ ID NO: 6485 - DNA, 274 bp, Zea mays
  Clone ID: 700577814H1
ggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttga

SEQ ID NO: 6486 - DNA, 279 bp, Zea mays
  Clone ID: 700100895H1
ggaccagatgggagtgggcgagctggtgaagtttgctacagagaggggccgcaaagctaggcctaacttgaaggtgggcatatgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagag

SEQ ID NO: 6487 - DNA, 276 bp, Zea mays
  Clone ID: 700100893H1
ggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaa

SEQ ID NO: 6488 - DNA, 282 bp, Zea mays
  Clone ID: 700442655H1
gccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagaaattatggttcctcttgttggaacaccacaggaactggggcatcaagtgactcttatccgccaagttgctgagaaagtgttcgccaatgtgggcaagactatcggg

SEQ ID NO: 6489 - DNA, 287 bp, Zea mays
  Clone ID: 700101289H1
cggacggtggtcgcttccagaagggaacatcgaggacattgtaagtgaattatgtgctgagacgggagccaaccaggaggatgccctcgcgcgaattgacaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatc

SEQ ID NO: 6490 - DNA, 285 bp, Zea mays
  Clone ID: 700446244H1
agtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtg

SEQ ID NO: 6491 - DNA, 312 bp, Zea mays
  Clone ID: 700210293H1
cccacgcgtccgccacgcgtccgcccacgcgtccgcgcacgtgggtgggggaaatgctgcgtctcgggatgctcaggcattcgcgtaaacgatgcggagaagctcgtgacgatcggaggccatgtgctgcgcgatggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaac

SEQ ID NO: 6492 - DNA, 285 bp, Zea mays
  Clone ID: 700404894H1
cagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttgtatatcgtaccctgaattgacagagatgcaag

SEQ ID NO: 6493 - DNA, 273 bp, Zea mays
  Clone ID: 700577581H1
acatgaccccttcgaggtcctggaccagaggggagtgggcgagctggtgaagtttgctacagagaggggccgcaaagctaggcctaacttgaaggtgggcatttgtggagaacacggtggagagccttcctctgtggccttcttcgcgaaggctgggctggattacgtttcttgctcccctttcagggtttcgattgctaggctagctgcagctcaggtgcttgtctgaggctgcctcctcattggcaaccggattgcctgctgctggtggat

SEQ ID NO: 6494 - DNA, 274 bp, Zea mays
  Clone ID: 700041646H1
gccaaccaggaggatgccctcgcgcgacttgaaaagctttcagaagtaaacccgatgcttggcttccgtgggtgcaggcttggtatatcgtaccctgaattgacagacatgcaagcccgggtcatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaaga

SEQ ID NO: 6495 - DNA, 271 bp, Zea mays
  Clone ID: 700442593H1
gccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggca

SEQ ID NO: 6496 - DNA, 273 bp, Zea mays
  Clone ID: 700581301H1
agctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggcattggattatgccggacagagcacatgttctttgcttcagacgaga

SEQ ID NO: 6497 - DNA, 268 bp, Zea mays
  Clone ID: 700043360H1
gagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcg

SEQ ID NO: 6498 - DNA, 267 bp, Zea mays
  Clone ID: 700044853H1
cgggagcaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaa

SEQ ID NO: 6499 - DNA, 275 bp, Zea mays
  Clone ID: 700581894H1
gaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagag

SEQ ID NO: 6500 - DNA, 279 bp, Zea mays
  Clone ID: 700582749H1
ctggtgaggtgatccttgggaagcagccgctttccccaccagcccttagtggtgatctgggaactttcatggcctgggtggatgatgttagaaagctcaaggtcctggtctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgt

SEQ ID NO: 6501 - DNA, 284 bp, Zea mays
  Clone ID: 700046068H1
gttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagagg

SEQ ID NO: 6502 - DNA, 264 bp, Zea mays
  Clone ID: 700045115H1
gggagagccccagggccaagaagtacaggagcatcaaccagatcactggcctcaggggcaccgccgtgaacgtgcagtgcatggtgttcggcaacatggggaacacttctggcaccggcgtgctcttcaccaggaaccccaacaccggagagaagaagctgtatggcgagttcctggtgaacgctcagggtgaggatgtggttgccggaataagaaccccagaggaccttgacgccatgaagaacctcatgccacaggcctacg

SEQ ID NO: 6503 - DNA, 266 bp, Zea mays
  Clone ID: 700053428H1
gaacgctcagggtgaggatgtggttgccggaataagaaccccagaggaccttgacgccatgaagaacctcatgccacaggcctacgacgagcttgttgagaactgcaacatcctggagagccactataaggaaatgcaggatatcgagttcactgtccaggaaaacaggctgtggatgttgcagtgcaggacagggaaacgtacgggcaaaagtgccgtgaagatcgccgtggacatggttaacgagggccttgttgagccccgct

SEQ ID NO: 6504 - DNA, 266 bp, Zea mays
  Clone ID: 700100830H1
gcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcga

SEQ ID NO: 6505 - DNA, 272 bp, Zea mays
  Clone ID: 700441945H1
attcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtggggaagttcattcccgtctatcatgctcagggcatcctccaacatgaccccttcgaggtcctggaccagaggggagtgggcgagctggtgaagtttgctacagagagggg

SEQ ID NO: 6506 - DNA, 276 bp, Zea mays
  Clone ID: 700576780H1
gatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttc

SEQ ID NO: 6507 - DNA, 265 bp, Zea mays
  Clone ID: 700442663H1
tgaagaacgacaccgacctcacggcctctgacctcaaagagctcgtgggtcagtacaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggacacttctggcaccggc

SEQ ID NO: 6508 - DNA, 287 bp, Zea mays
  Clone ID: 700439640H1
acatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatggggaaagttcattcc

SEQ ID NO: 6509 - DNA, 301 bp, Zea mays
  Clone ID: 700098515H1
cccacgcgtccggggcagctctggtggctgatgagatagcggacaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctctgtgagcttcttc

SEQ ID NO: 6510 - DNA, 271 bp, Zea mays
  Clone ID: 700430478H1
aggcgagctggtgaagcttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcatgctgctggtggatgtggtgatcaacagtattattacagagccatgct

SEQ ID NO: 6511 - DNA, 263 bp, Zea mays
  Clone ID: 700802781H1
cacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattg

SEQ ID NO: 6512 - DNA, 265 bp, Zea mays
  Clone ID: 700045313H1
gtgaggtgatccttgggaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggc

SEQ ID NO: 6513 - DNA, 265 bp, Zea mays
  Clone ID: 700045790H1
gggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaaca

SEQ ID NO: 6514 - DNA, 267 bp, Zea mays
  Clone ID: 700440018H1
cgctgaatgggtcgactggtgaggtgatccttggaaagcagccgctttccccaccagcccttagtggcgatctgggaactttcatggcctgggtggatgatgttagaaagctcaaggtcctggctaacgccgatacacctgatgatgcattgactgcgcgaaacaatggggcacaaggaattggattatgccggacagagcacatgttctttgcttcagacgagaggattaaggctgtcaggcagatgattatggctcccacgcttg

SEQ ID NO: 6515 - DNA, 266 bp, Zea mays
  Clone ID: 700100827H1
gctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctga

SEQ ID NO: 6516 - DNA, 315 bp, Zea mays
  Clone ID: 700617476H1
gccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgctctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaacccaggtgttcaagt

SEQ ID NO: 6517 - DNA, 284 bp, Zea mays
  Clone ID: 700577914H1
acgtgggtgggggaaatgctgcgtctcgggcggctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagacagctcaaggtcctggctaacgccgatacccctgatgatgcattgactgcgcgaaacaatggggcac

SEQ ID NO: 6518 - DNA, 259 bp, Zea mays
  Clone ID: 700440805H1
gccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggat

SEQ ID NO: 6519 - DNA, 300 bp, Zea mays
  Clone ID: 700097121H1
ccgctattctggtaaggccggagaccagccctgacgacgttggtggcacgcacgctgctgtggggattctcacagacaggggtggcacgacttcccacgctgctgtggtcgcacgtgggtgggggacacgctgcgtctcgggacgctcaggcactcgcgcaaacgacgcggagaagctcgtgacgaccggaggccacgtgctgcgcgaaggcgactggctgtcgctgaacgggtcgaccggcgacgtgaccctcggaaagcagccgctttccccaccagccctcactggcgctctgggaa

SEQ ID NO: 6520 - DNA, 270 bp, Zea mays
  Clone ID: 700043644H1
ctcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttc

SEQ ID NO: 6521 - DNA, 261 bp, Zea mays
  Clone ID: 700045549H1
gcgagttcctggtgaacgctcagggtgaggatgtggttgccggaataagaaccccagaggaccttgacgccatgaagaacctcatgccacaggcctacgacgagcttgttgagaactgcaacatcctggagagccactataaggaaatgcaggatatcgagttcactgtccaggaaaacaggctgtggatgttgcagtgcaggacagggaaacgtacgggcaaaagtgccgtgaagatcgccgtggacatggttaacgagg

SEQ ID NO: 6522 - DNA, 272 bp, Zea mays
  Clone ID: 700578928H1
gctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatga

SEQ ID NO: 6523 - DNA, 296 bp, Zea mays
  Clone ID: 700467315H1
gagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcgggatgatgtgggaaagttcattcccgtctatcttgctcagggcatcctccaacatgacgccttcgaggtcctggaccagaggggagtgggcgagcttgtgaagtttgctacagagaggggccgcaaagctaggccta

SEQ ID NO: 6524 - DNA, 287 bp, Zea mays
  Clone ID: 700583117H1
aaagtgttcgccaatgtgggcaagactatcgggtacaaagttggaataatgattgagatccccagggcagctctggtggctgatgagatagcggacaggctgaattcttctccttcggaacgaacgacctgacgcagatgacctttgggtacagcagggatgatgtggggaagttcattcgcgtctatcttgctcagggcatcctccaacatgaccccttcgaggtcctggaccagaggggagtgggcgagctggtgaagtttgctacagagagggggcgcaaagct

SEQ ID NO: 6525 - DNA, 274 bp, Zea mays
  Clone ID: 700801426H1
tgttcggcaacgtcgtcatggacatcccccgctcactgttcgaagagaagcttgagcacatgaaggaatccaaggggctgaagaacgacaccgacctgacggcctctgacctcaaagagctcgtgggtcagtacaaggaggtctacctctcagccaagggagagccattcccctcagaccccaagaagcagctggagctagcagtgctggctgtgttcaactcgtaggagagccccagggccaagaagtacagagcatcaaccagatcactggc

SEQ ID NO: 6526 - DNA, 268 bp, Zea mays
  Clone ID: 700041748H1
ggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgtt

SEQ ID NO: 6527 - DNA, 265 bp, Zea mays
  Clone ID: 700043365H1
tgaggacgttggtggcatgcacgcagctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggcgatctg

SEQ ID NO: 6528 - DNA, 267 bp, Zea mays
  Clone ID: 700042742H1
agccacctggtacagcttgtccatcctcagtttgagaacccgtcggcgtacaaggatcaagtcattgccagtggtctgccagcctcacctggggctgctgtgggccaggttgtgttcactgctgaggatgctgaagcatggcattcccaagggaaagctgctattctggtaagggcggagaccagccctgaggacgttggtggcatgcacgctgctgtggggattcttacagagaggggtggcatgacttcccacgctgctgtgatc

SEQ ID NO: 6529 - DNA, 270 bp, Zea mays
  Clone ID: 700041509H1
cccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtgggaaagttcattcccgtctatctt

SEQ ID NO: 6530 - DNA, 268 bp, Zea mays
  Clone ID: 700098536H1
ccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttaccccagtcatgtaaaacttccaaactgctccatggttcaaaactctgttcttcaatacatcatcaattatcgattataaa

SEQ ID NO: 6531 - DNA, 296 bp, Zea mays
  Clone ID: 700100481H1
aggaaatgcaggatatcgagttcactgtccaggaaaacaagctgtggatgttgcagtgcaggacacggaaacgtacgggcaaaagtgccgtgaagatcgccgtggacatggataacgagggccttgttgagccccgctcagcgatcaagatggtagagccaggacacctggaacagcttctccatcctcagtttgagaacccgtcggcgtacaaggatcaagtcattggcactggtctgccagcactcacctggggctgctgtgggccaggttgtgttcagtgctgaggatgctga

SEQ ID NO: 6532 - DNA, 262 bp, Zea mays
  Clone ID: 700578290H1
ctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccccaagttgctgagaaa

SEQ ID NO: 6533 - DNA, 267 bp, Zea mays
  Clone ID: 700045316H1
cgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctctcctccacgagttccttcgagaagggaacatcgaggacattgtaagt

SEQ ID NO: 6534 - DNA, 266 bp, Zea mays
  Clone ID: 700043494H1
gaccccttcgaggtcttggtccataagggagtgggcgagctggtgaagtttgctacagagaggggccgcaaagctaggcctaacttgaaggtgggcatttgtggagaacacggtggagagccttcgtctgtagccttcttcgcgaaggctgggctggattacgtttcttgctcccctttcagggttccgattgctaggctagctgcagctcaggtgcttgtctgaggctgcctcctcgttggcaaccggattgcctgctgctggtg

SEQ ID NO: 6535 - DNA, 257 bp, Zea mays
  Clone ID: 700044584H1
gttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgac

SEQ ID NO: 6536 - DNA, 348 bp, Zea mays
  Clone ID: 700619616H1
tgattatggctcccacagttgagctgaggcagcaggcgctggatcgccttctgccttaccagaggtctgacttcgaaggcatcttccgtgctatggatggactttcagtgactattcgacttctggaccctccactccacgagttccttccagaagggaacgtcgaggaaatcgtgcgtgaactgtgttctgagacgggagccaaccaggaggatgccctcgcacggatcgaaaagctttcggaagtaaacccgatgcttggcttccgtggctgcaggcttggtatatcgtaccctgagctaacagaaatgcaaggccgtgccatctttgaagctgctataacgatga

SEQ ID NO: 6537 - DNA, 272 bp, Zea mays
  Clone ID: 700041517H1
ttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctg

SEQ ID NO: 6538 - DNA, 277 bp, Zea mays
  Clone ID: 700100133H1
ggcgtgctcttcaccaggaaccccaacaccggagagaagaagctgtatggcgagttcctggtgaacgctcagggtgaggatgtggttgccggaataagaaccccagaggaccttgacgccaatgaagaacctcatgccacaggcctacgacgagcttgttgagaactgcaacatcctggagagccactacaaggaaatgcaggatatcgagttcactgtccaggaaaacaggctgtggatgttgcagtgcaagacagggaaacgtacgggcaaaagt

SEQ ID NO: 6539 - DNA, 270 bp, Zea mays
  Clone ID: 700456453H1
gagctggtgaagcttgctacagagaggggccgcaaagctaggcctaacttgaaggtgggcatttgtggagaacacggtggagagccttcctctgtggccttcttcgcgaaggctgggctggattacgtttcttgctccctttcagggttccgattgctaggctagctgcagctcaggtcgctgtctgaggctgcctcctcattggcaaccggattgcctgctgctggtggatgtggtgatcaacagtattattacagagccatgctatgt

SEQ ID NO: 6540 - DNA, 264 bp, Zea mays
  Clone ID: 700440516H1
caatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcag

SEQ ID NO: 6541 - DNA, 265 bp, Zea mays
  Clone ID: 700042888H1
ggcagctctggtggctgatgagatagcggacaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggag

SEQ ID NO: 6542 - DNA, 259 bp, Zea mays
  Clone ID: 700157245H1
cctccaacatgaccccttcgaggtcctggaccagaagggagtgggcgagctggtgaagtttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccgg

SEQ ID NO: 6543 - DNA, 260 bp, Zea mays
  Clone ID: 700261321H1
gtaccctgaattgacagagatgcaagcacgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacaggc

SEQ ID NO: 6544 - DNA, 272 bp, Zea mays
  Clone ID: 700045657H1
aacacggtggagagccttcctctgtcgccttcttcgcgaaggctgggctggattacgtttcttgctcccctttcagggttccgattgctaggctagctgcagctcaggtgcttgtctgaggctgcctcctcaatggcaaccggattgcctgctgctggtggatgtggtgatcaacagtattattacagagccatgctatgtgaacattactagtagcagtgctcataaaagctacaatcccatgtcctttttttccccagtcatgtaaaact

SEQ ID NO: 6545 - DNA, 265 bp, Zea mays
  Clone ID: 700042469H1
agcggacaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcg

SEQ ID NO: 6546 - DNA, 284 bp, Zea mays
  Clone ID: 700434549H1
acaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttgtaactatgattgagatccccatggcagctctggtggctcatgagatagcggagcaggctgaattcttctccttcgggacgaacgacctgaagcacatgacctttgggtacagcagggatgatgtgggctagtc

SEQ ID NO: 6547 - DNA, 266 bp, Zea mays
  Clone ID: 700433527H1
tattcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtgggaaagttcattcccgtctatcttgctcaggg

SEQ ID NO: 6548 - DNA, 266 bp, Zea mays
  Clone ID: 701177258H1
aatcgataattgatgatgtattgaagaacagagttttgaaccatggagcagtttggaagttttacatgactggaaaaaaaaagggagatgggattgtagcttttatgagcactgctactagtaatgttcacatagcatggctctgtaataatactgttgatcaccacatccacgagatactggcaatccggttgccaacgaggaggcagcctcagacaagcacctgagctgcagctagcctagcaatcggaaccctgaaaggggag

SEQ ID NO: 6549 - DNA, 271 bp, Zea mays
  Clone ID: 700440442H1
ccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccaga

SEQ ID NO: 6550 - DNA, 284 bp, Zea mays
  Clone ID: 700432310H1
agtgactcttatacgccaagttgctgagaaagtgttcgccaatgtgggcaagactatcgggtacaaagttggaacaatgattgagatccccagggcagctctggtggatgatgagatagcggagaaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctgg

SEQ ID NO: 6551 - DNA, 292 bp, Zea mays
  Clone ID: 700026635H1
gtcgacggaggcgtgccagcagtaccaggacgccgggtgcgccctccccgcgggcctctgggccgagatcgtcgacggcctgcagtgggtggacgagtacatgggcgccaccctgggcgatccgcagcgcccgctcctgctctccgtccgctccggcgccgccgtgtccatgcccggcatgatggacacggtgctcaacctggggctcaacgacgaagtggccgccgggctggcggccaagagcggggagcgcttcgcctacgactccttccgccgcttcctcgacatgttc

SEQ ID NO: 6552 - DNA, 266 bp, Zea mays
  Clone ID: 700043320H1
gcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctg

SEQ ID NO: 6553 - DNA, 258 bp, Zea mays
  unsure (1)...(258): unsure at all n locations
  Clone ID: 700025682H1
caaagagctcgtgggtcagtacaaggaggtctacctctcagccaagggagagccattcccctcagaccccaagaagcagctggagctggcagtgctggctgtgttcaactcgtgggagagccccagggccaagaagtacaggagcatcaaccagatcactggcctcaggggcaccgccgtgaacgtgcagtgcatggtgttcantaacatggggaacacttctggcaccggcgtgctcttcaccaggaaccccaacac

SEQ ID NO: 6554 - DNA, 273 bp, Zea mays
  Clone ID: 700441415H1
ttgactcccggtgaccatccgactcctggaccctcccctccacgagttccttccagaagggaacatcgaggacattgtaagtgaattatgtgctgagacgggagccaaccaggagatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttc

SEQ ID NO: 6555 - DNA, 272 bp, Zea mays
  Clone ID: 700460762H1
aattgacagagatgcaagcccgggccatttttgaagctgctatagcaatgaccaaccagggtgttcaagtgttcccagagataatggttcctcttgttggaacaccacaggaactggggcatcaagtgactcttatccgccaagttctgagaaagtgttcgccaatgtgggcaagactatcgggtacaaagttggaacaatgattgagatccccagggcagctctggtggctgatgagatagcggacaggctgaattcttctccttcggaag

SEQ ID NO: 6556 - DNA, 278 bp, Zea mays
  Clone ID: 700053387H1
gattgagatccccagggcagctctggtggctgatgagatagcggacaggctgaattcttctccttcggaacgaacgacctgacgcagatgacctttgggtacagcagggatgatgtgggaaagttcattcccgtctatcttgctcagggcattctccaacatgaccccttcgagatgcccgtacacctaccaggtcctggaccagaggggagtgggcgagctggtgaagcttgctacagagaggggccgcaaagctaggcctaacttgaaggtgggca

SEQ ID NO: 6557 - DNA, 261 bp, Zea mays
  Clone ID: 700044829H1
ccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgat

SEQ ID NO: 6558 - DNA, 274 bp, Zea mays
  Clone ID: 700576848H1
caacgacctgacgcagatgacctttgggtacagcagggatgatgtggggaagttcattcccgtctatcttgctcagggcatcctccaacatgaccccttcgaggtcctggaccagaggggagtgggcgagctggtgaagtttgctacagagaggggccgcacagctaggcctaacttgaaggtgggcatttgtggagaacacggtggagagccttcctctgtggccttcttcgcgaaggctgggctggattacgtttcttgctcccctttcagg

SEQ ID NO: 6559 - DNA, 256 bp, Zea mays
  Clone ID: 700195073H1
agcggacaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctctgtgg

SEQ ID NO: 6560 - DNA, 260 bp, Zea mays
  Clone ID: 700044956H1
gtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggcca

SEQ ID NO: 6561 - DNA, 269 bp, Zea mays
  Clone ID: 700441974H1
attcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtggggaagttcattcccgtctatcttgctcagggcatcctccaacatgaccccttcgaggtcctggaccagaggggagtgggcgagctggtgaagtttgctacagaga

SEQ ID NO: 6562 - DNA, 262 bp, Zea mays
  Clone ID: 700045323H1
gtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtgggaaagttcattcccgtctatcttgctcagggcattctccaacatgaccccttcgaggtcctggacca

SEQ ID NO: 6563 - DNA, 275 bp, Zea mays
  Clone ID: 700584010H1
atcgggtacaaagttggaacaatgattgagatccccagggcagctctggtggctgatgatatagcggacaggctgaattcttctccttcggaacgaacgacctgacgcagatgacctttgggtacagcagggatgatgtggggaagttcattcccgtctatcttgctcagggcatcctccaacatgaccccttcgaggtcctggaccagaggggagtgggcgacctgtgaagttgctacagagaggggccgcaaagctaggcctaacttgaaggt

SEQ ID NO: 6564 - DNA, 261 bp, Zea mays
  Clone ID: 700098611H1
cagagaccagccctgaggacgttggtggcatgcacgcagctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccag

SEQ ID NO: 6565 - DNA, 249 bp, Zea mays
  Clone ID: 700043635H1
ccgattgccaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgatt

SEQ ID NO: 6566 - DNA, 255 bp, Zea mays
  Clone ID: 700441843H1
cagagaccagccctgaggacgttggtggcatgcacgcagctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccc

SEQ ID NO: 6567 - DNA, 305 bp, Zea mays
  Clone ID: 700621537H1
gccgtatctgaggtctgacttcgaaggcattttccgtgctatggatggactcccggtgaccatccgactcttggaccctcccctccacgagttccttccagaagggaatctccctgacactgtaagtgaattatgtgctgagacgggagccaaccaggaggatgccctcgcgcgaattaagagctttcagaagtaaacccgatgcttggcttccgtgggtgcaggcttggtatatcgtaccctgaattgacagagatgcaagcccgggccatttttgcagctgctatagcaatgaccaaccaggg

SEQ ID NO: 6568 - DNA, 263 bp, Zea mays
  Clone ID: 700438416H1
caccagatcactggcctcaggcgcaccgccgtgaacgtgcagtgcatggtcttcggcaacatggggaacacttctggcaccggcgtgctcttcactaggaaccccaacaccggagagaagaagctgtatggcgagttcctggtgaacgccagggtgaagatgtggttgccggaataagaaccccagaggaccttgacgccatgaagaacctcatgccacagggctacgacgagcttgttgagaactgcaacatcctggagagc

SEQ ID NO: 6569 - DNA, 257 bp, Zea mays
  Clone ID: 700043045H1
gggcagctctggtggctgatgagatagcggacaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaaa

SEQ ID NO: 6570 - DNA, 263 bp, Zea mays
  Clone ID: 700433859H1
gtttcttgctcccctttcagggttccgattgctaggctagctgcagctcaggtgcttgtctgaggctgcctcctcgttggcaaccggattgcctgctgctggtggatgtggtgatcaacagtattattacagagccatgctatgtgaacattactagtagcagtgctcataaaagctacaatcccatctcccttttttttccagtcatgtaaaacttccaaactgctccatggttcaaaactctgttcttcaatacatcatca

SEQ ID NO: 6571 - DNA, 264 bp, Zea mays
  Clone ID: 700580039H1
gccggacagagcacatgttctttgcttcagacgagaggattaaggctgtcaggcagatgattatggctcccacgcttgagctgaggcagcaggcgctcgaccgtctcttgccgtatcagatgtcttacttcgaaggcattttccgtgctatggatggactcccggtgaccatccgactcctggaccctcccctccacgagttccttccagaagggaacatcgaggacattgtaagtgaattatgtgctgagacgggagccaacc

SEQ ID NO: 6572 - DNA, 267 bp, Zea mays
  Clone ID: 700208040H1
cccacgcgtccgcggacgcgtgggccggaataagaaccccagaggaccttgacgccatgaagaacctcatgccacaggcctacgacgagcttgatgagaactgcaacatcctggagagccactacaaggaaatgcaggatatcgagttcactgtccaggaaaacaggctgtggatgttgcagtgcaggacagggaaacgtacgggcaaaagtgccgtgaagatcgccgtggacatggttaacgaggcttgttgagcccgctcagcga

SEQ ID NO: 6573 - DNA, 253 bp, Zea mays
  Clone ID: 700043891H1
ctcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaacc

SEQ ID NO: 6574 - DNA, 246 bp, Zea mays
  Clone ID: 701175175H1
cgcttccgtgggtgcaggcttggtatatcgtaccctgaattgacagacatgcaagcccgggccatttttgaagctgctatagcaatgaccaaccagggtgttcaagtgttcccagagataatggttcctcttgttggaccaccacaggaactggggcatcaagtgactcttatccgccaagtcgctgagaaagtgttcgccaatgtgggcaagactatcgggtacaaagttggaacaatgattgag

SEQ ID NO: 6575 - DNA, 251 bp, Zea mays
  Clone ID: 700210840H1
gccctgaggacgttggtggcatgcacgcagctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccacca

SEQ ID NO: 6576 - DNA, 314 bp, Zea mays
  Clone ID: 700086935H1
tgccggacagagcacatgttcttcgcttcggatgagaggattaaggctgtgaggcagatgattatggctcccacagttgagctgaggcagcaggcgctggatcgccttctgccttaccagaggtctgacttcgaaggcattttccgtgctatggatggactttcagtgactattcgacttctggaccctcccctccacgagttccttccagaagggaacgtcgaggaaatcgtgcgtgaactgtgttctgagacgggagccaaccaggaggatgccctcgcacggatcgaaaagctttcggaagtaaacccgat

SEQ ID NO: 6577 - DNA, 258 bp, Zea mays
  Clone ID: 700044111H1
caggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtgggaaagttcattcccgtctatcttgctcagggcattctccaacatg

SEQ ID NO: 6578 - DNA, 280 bp, Zea mays
  Clone ID: 700576815H1
ctgacttcgaaggcattttccgtgctatggatggactcccggtgaccatccgactcttggaccctcccctccacgagttccttccagaagggaacatcgatgacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaat

SEQ ID NO: 6579 - DNA, 265 bp, Zea mays
  Clone ID: 700438522H1
gcgatcaagatggtagattcaggccacctggaccagcttcttcatcctcagtttgagaacccgtcggcgtacaaggatcaagtcattgccactggtctgccttcctcacctggggctgctgtgggccaggttgtgttcactgctgaggatgctgaagcatggcattcccaagggaaagctgctattctggtaagggcggagaccagccctgaggacgttggtggcatgcacgctgctgtggggattcttacagagagggtggcat

SEQ ID NO: 6580 - DNA, 267 bp, Zea mays
  Clone ID: 700578239H1
ggtggctgatgagatgcgtagaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacgtggagagccttcctctgt

SEQ ID NO: 6581 - DNA, 240 bp, Zea mays
  Clone ID: 700044219H1
gccgtgaacgtgcagtgcatggtgttcggcaacatggggaacacttctggcaccggcgtgctcttcaccaggaaccccaacaccggagagaagaagctgtatggcgagttcctggtgaacgctcaggctgaggatgtggttgccggaataagaaccccagaggaccttgacgccatgaagaacctcatgccacaggcctacgacgagcttgttgagaactgcaacatcctggagagccac

SEQ ID NO: 6582 - DNA, 266 bp, Zea mays
  Clone ID: 700220031H1
cccacgcgtccgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgtgaatt

SEQ ID NO: 6583 - DNA, 248 bp, Zea mays
  Clone ID: 700454149H1
ggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatatccctgatgatgcattgactgcgcgaaacaatggggcacaaggacttggattatgccggacagagcacatgttctttgc

SEQ ID NO: 6584 - DNA, 270 bp, Zea mays
  Clone ID: 700578265H1
gctcgatctcacctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagatatggttcctcttg

SEQ ID NO: 6585 - DNA, 248 bp, Zea mays
  Clone ID: 700442849H1
gggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcgccgctttccccaccagcccttagtggtgatctgggaactttcatggcctgggtggatgatgttag

SEQ ID NO: 6586 - DNA, 273 bp, Zea mays
  Clone ID: 700044381H1
gacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtgagcttcttcgcgaaggctgggctggattacgtttcttgctcccctttcagggttccgat

SEQ ID NO: 6587 - DNA, 251 bp, Zea mays
  Clone ID: 700578031H1
agaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcaa

SEQ ID NO: 6588 - DNA, 277 bp, Zea mays
  Clone ID: 700802158H1
ctcacgcagatgacctttggctacagcagggatgatgtggggaagttcatccccatttatctggctcagggcatcctccagcatgaccccttcgaggttctcgaccagagaggagtgggcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcg

SEQ ID NO: 6589 - DNA, 269 bp, Zea mays
  Clone ID: 700581537H1
gtgttcccagagataatggttcctcttgttggaacaccacaggaactggggcatcaagtgactcttatccgccaagttgctgagaaagtgttcgccaatgtgggcaagactattgggtacaaagttggaacaatgattgagatccccagggcagctctggtggctgatgagatagcggacaggctgaattcttctccttcggaacgaacgacctgacgcagatgacctttgggtacagcagggatgatgtgggaaagttcattcccgtc

SEQ ID NO: 6590 - DNA, 273 bp, Zea mays
  Clone ID: 700447772H1
agtgactcttatccgccagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtgggaaagttcattcccgtctatcatgctcagggcattctccaacatgaccccttcgaggtcctggaccagagggagtggg

SEQ ID NO: 6591 - DNA, 243 bp, Zea mays
  Clone ID: 700044908H1
gtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacaga

SEQ ID NO: 6592 - DNA, 229 bp, Zea mays
  Clone ID: 700806626H1
caagggaaagctgctattctggtaagggcggagaccagccctgaggacgttggtggcatgcacgctgctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcaaaggtgagtggc

SEQ ID NO: 6593 - DNA, 237 bp, Zea mays
  Clone ID: 700580766H1
cttcgaggtcctggaccagaggggagtgggcgagctggtgaagtttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattgg

SEQ ID NO: 6594 - DNA, 295 bp, Zea mays
  Clone ID: 700100482H1
gaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtggg

SEQ ID NO: 6595 - DNA, 249 bp, Zea mays
  Clone ID: 700428285H1
ggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtcctggaccagaggggagtgggcgagctggtgaagcttgctacagagaggggccgcaaagctaggcctaacttgaaggtgggcatttgtggagaacaggtggaga

SEQ ID NO: 6596 - DNA, 251 bp, Zea mays
  Clone ID: 700158124H1
aagttggaacaatgattgagatccccagggcagctctggtggctgatgagatagcggacaggctgaattcttctccttcggaacgaacgacctgacgcagatgacctttgggtacagcagggatgatgtggggaagttcattcccgtctatcttgctcagggcatcctccaacatgaccccttcgaggtcctggaccagaggggagtgggcgagctggtgaagtttgctacagagaggggccgcaaagcta

SEQ ID NO: 6597 - DNA, 262 bp, Zea mays
  Clone ID: 700439158H1
gagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgcttaaacgggagccaaccaggaggatgccctcgcgcgatttgaaaact

SEQ ID NO: 6598 - DNA, 277 bp, Zea mays
  Clone ID: 700577046H1
cgcagatgacctttgggtacagcagggatgatgtggggaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctag

SEQ ID NO: 6599 - DNA, 298 bp, Zea mays
  Clone ID: 700098026H1
acccgatgcttggcttccgtggctgcaggcttggtatatcgtaccctgagctaacagaaatgcaagcccgtgccatctttgaagctgctatagcgatgaccaaccagggcgttcaagtctttccagagataatggttcctcttgttggaacaccgcagaattgggacatcaggtggcccttatccgtcaagtcgctaacaaagttttcaccagtatggggaaaactattgggtacaagatcggaacgatgattgagattcccagggcagctctagtggctgacgagatcgcggacagg

SEQ ID NO: 6600 - DNA, 308 bp, Zea mays
  Clone ID: 700099229H1
cccacgcgtccgcccacgcgtccgcccacgcgtccgcccacgcgtccgcccacgcgtccgcccacgcgtccgcaagtcattgccactggtctgccagcctcacctggggctgctgtgggccaggttgtgttcactgctgaggatgctgaagcatggcattcccaagggaaagctgctattctggtaagggcagagaccagccctgaggacgttggtggcatgcacgcagctgtggggattcttacagagaggggtggcatgacttcccacgctgctgtggtcgcacgtgggtgggggaaatgctgcgt

SEQ ID NO: 6601 - DNA, 245 bp, Zea mays
  Clone ID: 700045027H1
gcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccaga

SEQ ID NO: 6602 - DNA, 253 bp, Zea mays
  Clone ID: 701177010H1
ttttcttaagcggtaattgatgatgtattgaagaacagagttttgaaccatggagcagtttggaagttttacatgactggaaaaaaaaagggagatgggattatagcttttatgagcactgctactagtaatgttcacatagcatggctctgtaataatactgttgatcaccacatccaccagcagcgggggatccggttgccaacgaggaggcagcctcagacaagcacctgagctgcagctagcctagcaa

SEQ ID NO: 6603 - DNA, 246 bp, Zea mays
  Clone ID: 700044687H1
cggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtgggaaagttcattcccgtctatcttgctcagggcattctcca

SEQ ID NO: 6604 - DNA, 275 bp, Zea mays
  Clone ID: 700438501H1
gccatgaagaacctcatgccacaggcctacgacgagcttgttgagaactgcaacatcctggagccactacaaggaaatgcaggatatcgagttcactgtccaggaaaacaggctgtggatgttgcagtgcaggacagggaaacgtacgggcaaaagtgccgtgaagatcgccgtggacatggttaacgagggccttgttgagccccgctcagcgatcaagatggtagagtcaggcccctggaccagcttctccatcctcagtttgagaaccgtcg

SEQ ID NO: 6605 - DNA, 241 bp, Zea mays
  Clone ID: 700044229H1
accagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacc

SEQ ID NO: 6606 - DNA, 256 bp, Zea mays
  Clone ID: 700447355H1
gagatagggacaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgtgcatttgtggagaacacggtggagagccttcctct

SEQ ID NO: 6607 - DNA, 269 bp, Zea mays
  Clone ID: 700806248H1
cgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactgggcatcagtgactcttatcgccagttgctgagaagtgttcgccatgtgggc

SEQ ID NO: 6608 - DNA, 239 bp, Zea mays
  Clone ID: 700044220H1
cacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacc

SEQ ID NO: 6609 - DNA, 257 bp, Zea mays
  Clone ID: 700193031H1
gattgagattcccagggcagctctagtggctgacgagatcgcggagaggctgaattcttctcctttggaacgaacgacctcacgcagatgacctttggctacagcagggatgatgtggggaagttcatccccatttatctggctcagggcatcctccagcatgaccccttcgaggttctcgaccagagaggagtgggcgagctggttaagcttgctacagagaggggccgcaaagctaggcctaacttgaaggtggg

SEQ ID NO: 6610 - DNA, 261 bp, Zea mays
  Clone ID: 700581571H1
gccggacagagcacatgttctttgcttcagacgagaggattaaggctgtcaggcagatgattatggctcccacgcttgagctgaggcagcaggcgctcgaccgtctcttgccgtatcagaggtctgacttcgaagcattttccgtgctatggatggactcccgctgaccatccgactcctggaccctcccctccacgagttccttccagaagggaacatcgaggacattgtaagtgaattatgtgctgagacgggagccaa

SEQ ID NO: 6611 - DNA, 312 bp, Zea mays
  Clone ID: 700100987H1
ctccactcgtccgctgacgctgggcgaccgtggtcggacgcgtgggggttgtgttcactgctgaggatgctgaagcatggcattcccaagggaaagctgctattctggtaagggccgagaccagccctcaggacgttactggcatgcacgcagctgtggggattcttacagagaggggtggcatgacttcccacgctgctgtggtcgcacgtaggtgggggaaatgctgcgtctcgggatgctcaggcattcgcgtaaacgatgcggagaagctcgtgacgatctgaggccatgtgctgcgcgaaggtgagt

SEQ ID NO: 6612 - DNA, 230 bp, Zea mays
  Clone ID: 700439748H1
gggatgctcaggcattcgcgtaaacgatgcggagaagctcgtgacgatcggaggccatgtgctgcgcgaaggtgagtggctgtcgccgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatg

SEQ ID NO: 6613 - DNA, 258 bp, Zea mays
  Clone ID: 700441474H1
gtcctcgcgcgaattgaaaagctttcagaagtaaacccgatgcttggcttccgtgggtgcaggcttggtatatcgtaccctgaattgacagagatgcaagccgggccatttttgaagctgctatagcaatgaccaaccagggtgttcaagtgttcccagagataatggttcctacttgttggaacaccacaggaactggggcatcaagtgactcttatccgccaagttgctgagaaagtgttcgccaatgtgggcaag

SEQ ID NO: 6614 - DNA, 278 bp, Zea mays
  Clone ID: 700042302H1
gttctagatcgccggcggccgctcgcgatctagatcaagtgactcttatccgccaagttgctgagaaagtgttcgccaatgtgggcaagactatcgggtacaaagttggaacaatgattgagatccccagggcagccctggtggctgatgagatagcggacaggctgaattcttctccttcggaacgaacgacctgacgcagatgacctttgggtacagcagggatgatgtgggaaagttcattcccgtctatcttgctcagggcatcctccaacatg

SEQ ID NO: 6615 - DNA, 304 bp, Zea mays
  Clone ID: 700616327H1
ggttcctcttgttggaacaccgcagaattgggacatcaggtggcccttatccgtcaagtcgctaacaaagttttcaccagtatggggaaaactattgggtacaagatcggaacgatgattgagattcccagggcagctctagtggctgacgagatcgcggagcaggctgaattcttctcctttggaacgaacgacctcacgcagatgaccattggctacagcagggatgatgtggggaagttcatccccatttatctggctcagggcatcctccagcatgaccccttcgaggttctcgaccaga

SEQ ID NO: 6616 - DNA, 243 bp, Zea mays
  Clone ID: 700194736H1
gtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtg

SEQ ID NO: 6617 - DNA, 266 bp, Zea mays
  Clone ID: 700578367H1
ttaggctgtcaggcagatgattatggctcccacgcttgagctgaggcagcaggcgctcgatcgtctcttgccgtatcagaggtctgacttcgaaggcattttccgtgctatggatggactcccggtgaccatccgactcctggacactctcctccaggagttccttccagaagggaacatcgaggacattctaagtgacttatgtgctgagacgggagccaaccaggaggatgccctcgcgcgaattgaaaagctttcagaagtaa

SEQ ID NO: 6618 - DNA, 235 bp, Zea mays
  Clone ID: 700042652H1
caggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaattcttctccttcggaacgaacgacctgacgcagatgacctttgggtacagcagggatgatgtgggaaagttcattcccgtctatct

SEQ ID NO: 6619 - DNA, 233 bp, Zea mays
  Clone ID: 700397564H1
cgcagatgacctttgggtacagcagggatgatgtgggaaagttcattcccgtctatcttgctcagggcattctccaacatgaccccttcgaggtcctggaccagatgggagtgggcgagctggtgaagcttgctacagagaggggccgcaaagctaggcctaacttgaaggtgggcatttgtggagaacacggtggagagcctcctctgtagcctcttcgcgaaagctgggct

SEQ ID NO: 6620 - DNA, 250 bp, Zea mays
  Clone ID: 700434288H1
taattgctaggctagctgcagctcaggtgcttgtctgatgctgcctcctcattggcaaccggattgcctgctgctggtggatgtggggatcaacagtatgattacagagccatgctatgtgaacattactagtagcagtgctcataaaagctacaatcccatgtcctttttttccccagtcatgtagaacttccaaactgctccatggttcagaactctgttcttcaatacatcatcaattatcgattaa

SEQ ID NO: 6621 - DNA, 277 bp, Zea mays
  Clone ID: 700429519H1
agggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggaactcctgttgctgattagatagcggacaagctgaattcttctccttcgggaacgaacgacctgacgcagatgacctttgggtacagcagggatgatgtggggaagttcattccc

SEQ ID NO: 6622 - DNA, 216 bp, Zea mays
  Clone ID: 700438174H1
caggcattccgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcatggtcctggctaacgccgatacgcctga

SEQ ID NO: 6623 - DNA, 280 bp, Zea mays
  Clone ID: 700583672H1
ttgagatccccagggcagctctggtggctgatgagatagcggacaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagagggagcgcaaagctaggcctaacttgaaggtgggcatttgtggagaacacggtggagag

SEQ ID NO: 6624 - DNA, 228 bp, Zea mays
  Clone ID: 700441307H1
atcgagccgcatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagc

SEQ ID NO: 6625 - DNA, 178 bp, Zea mays
  Clone ID: 701176710H1
aatcgataattgatgatgtattgaagaacagagttttgaactatggagcagtttggaagttttacatgactggaaaaaaaaagggagatgggattgtagcttttatgagcactgctactagtaatgttcacatagcatggctctgtaataatactgttgatcaccacatccacaagca

SEQ ID NO: 6626 - DNA, 243 bp, Zea mays
  Clone ID: 700581577H1
gaacgacctgacgcagatgacctttgggtacagcagggatgatgtggggaagttcattcccgtctatcttgctcagggcatcctccaacatgaccccttcgaggtcctggaccagaggggagtgggcgagctgggaagtttgctacagagaggggccgcaaagctaggcctaacttgaaggtgggcatttgtggagaacacggtggagagcttactctgtagccttcttcgcgaagctgggct

SEQ ID NO: 6627 - DNA, 280 bp, Zea mays
  Clone ID: 700428336H1
ttgagatccccagggcagctctggtggctgatgagatagcggagcaggctgcattcttctccttcggaacgaacgatctgacgcagatgacctttgggtacagcagggatgatgtgggaaagttccctaccgtctatcttgctcagggcatcctccaacatgaccccttcgaggtcctggaccagcggggagtgggcgagctggtgaagtttgctacagagaggggccgcaaagctaggcctaccttgaaggtgggcatttgtggagaaccggtggagag

SEQ ID NO: 6628 - DNA, 234 bp, Zea mays
  Clone ID: 700018165H1
gcacgagggctgatgagatagcggacaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaagggagtgggcgagctggtgaagtttgctacagagaggggccgcaaagctaggcctaacttgaaggt

SEQ ID NO: 6629 - DNA, 216 bp, Zea mays
  Clone ID: 700405414H1
ggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcagagaccagccctgaggacgttggtggcat

SEQ ID NO: 6630 - DNA, 242 bp, Zea mays
  Clone ID: 700239413H1
gggatgctcaggcattcgcgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgc

SEQ ID NO: 6631 - DNA, 262 bp, Zea mays
  Clone ID: 700581594H1
gggcagctctggtggctgatgagatagcggagaggctgaattcttctgcttcggaacgagcgacctgacggagatgacctttgggtacagcagggatgatgtgggaaagtgcattcccgtctatcttgctcagggcattctccaagatgaccccttcgaggtcctggacgagaggggagtgggcgagctggtgaagcttgctacagagaggggccgcaaagctaggcctaacttgaaggtgggcatttgtggagaacacggt

SEQ ID NO: 6632 - DNA, 309 bp, Zea mays
  Clone ID: 700433062H1
actaacgaactccgcgtacgcggctccctattcggctcccgggctggactcccggtgaccatccgattcctggaccctcccctgcacgagatccttccagaagggaacatcgaggacattgtacgtgacttatgtgctgagacgggagctaaccaggcggatgccctcgcgcgaattgaaaagctttcagcacgtaaacccgatgcttggcttccgtgggcgctggctccgtatatcgtaccctgcattgccagcgctgcaagctcgcgccatttttgcaagctgctatagacatgaccaaccaggtgt

SEQ ID NO: 6633 - DNA, 271 bp, Zea mays
  Clone ID: 700581979H1
gcggagaggctgaattcttctccttcggaacgaacgacctgacgcagatgacctttgggtacagcagggatgatgtggggaagttcattcccgtctatcttgctcagggcatcctccaacatgaccccttcgaggtcctggaccagaggggagtgggcgagctggtgaagtttactgcagagaggggccgcaaagctaggcctaacttgaaggtgggcatttgtggagaacaggtggagagccttcctctgtggcctcttcgcgaagctgg

SEQ ID NO: 6634 - DNA, 255 bp, Zea mays
  Clone ID: 700441332H1
taatcacgagactcagaattcggatcgaggtacgctgatgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtagctgtcgctgaatgggtcgactggtgaggtgatccttggaaagcagccgctttcccca

SEQ ID NO: 6635 - DNA, 219 bp, Zea mays
  Clone ID: 700441363H1
caaggatcaagtcattgccactggtctgccagcatcacctggggctgctgtgggccaggttgtgttcactgctgaggatgctgaagcatggcattcccaagggaaagctgctattctggtaagggcggagaccagccctgaggacgttggtagcatgcacgctgctgtggggattcttacagagaggggtggcatgacttcccacgctgctgtggtcgc

SEQ ID NO: 6636 - DNA, 275 bp, Zea mays
  Clone ID: 700807116H1
ggttgctttcttcgccaagactgggctggattacgtttcttgctcccctttcagggtcccgatcgctaggctagctgcagctcaggtgcttgtctgaggggctgcctcctcgttggcagcctgctgttggtgcatctggtgattaataatactactatgacagagccatatgctctgtgaagagtattagtagcagcgctcataaaagctacagttccatctatattctcagctatgtaaaacttccaaactgttcatgcttacaactgagggtt

SEQ ID NO: 6637 - DNA, 256 bp, Zea mays
  Clone ID: 700800557H1
gaaatgcaaggccgtgccatctttgaagctgctataacgatgaccaaccagggcgttcaagtctttccagagataatggttcctcttgttggaacaccgcaggaattgggacatcaggtggcccttatccgtcaagtcgctaacaaagttttcaccagtatgggtaaaactattgggtacaagatcgggacgatgattgagattcccagggcagctctagtggctgacgagatcgcggagcaggctgaattcttct

SEQ ID NO: 6638 - DNA, 282 bp, Zea mays
  Clone ID: 700803903H1
gaccaaccagggcgttcaagtctttccagagataatggttcctcttgttggaacaccgcaggaattgggacatcaggtggcccttatccgtcaagtcgctaacaaagttttcaccagtatgggtaaaactattgggtacaagatcgggacgatgattgagattcccagggcagctctagtggctgacgagatcgcggagcaggctgaattcttctcctttggaacgaacgacctcacgcagatgacctttggctacagcagggatgatgtggggcaattcat

SEQ ID NO: 6639 - DNA, 244 bp, Zea mays
  Clone ID: 700257764H1
cgaccgtctctagcatggaaaacataatcatctgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcatacaccgtgctataactggactcccggtgaccatccgactcctggaccctcccctccacgagttccttccaga

SEQ ID NO: 6640 - DNA, 237 bp, Zea mays
  Clone ID: 700207392H1
cggacgctccgcccacgcgtccgcccacgcgtccgccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggacaggctgaat

SEQ ID NO: 6641 - DNA, 246 bp, Zea mays
  Clone ID: 700193933H1
acttcgaaggcattttccgtgctatggatggactttcagtgactattcgacttctggaccctcccctccacgagttccttccagaagggaacgtcgaggaaatcgtgcgtgaactgtgttctgagacgggagccaaccaggaggatgccctcgcacggatcgaaaagctttcggaagtaaacccgatgcttggcttccgtggctgcaggcttggtatatcgtaccctgagctaacagaaatgcaag

SEQ ID NO: 6642 - DNA, 270 bp, Zea mays
  Clone ID: 700806409H1
ggttgctttcttcgccaagactgggctggattacgtttcttgctcccctttcagggtcccgatcgctaggctagctgcagctcaggtgcttgtctgaggggctgcctcctcgttggcagcctgctgttggtgcatctggtgattaataatactactatgacagagccatatgctctgtgaagagtattagtagcagcgctcataaaagctacagttccatctattttctcagctatgtaaaacttccaaactgttcatgctataaaactg

SEQ ID NO: 6643 - DNA, 256 bp, Zea mays
  Clone ID: 700195405H1
cgatgaccaaccagggcgttcaagtctttccagagataatggttcctcttgttggaacaccgcaggaattgggacatcaggtggcccttatccgtcaagtcgctaacaaagttttcaccagtatgggtaaaactattgggtacaagatcgggacgatgattgagattcccagggcagctctagtggctgacgagatcgcggagcaggctgaattcttctcctttggaacgaacgacctcacgcagatgacctttgg

SEQ ID NO: 6644 - DNA, 229 bp, Zea mays
  Clone ID: 700579292H1
attcttctccttcggaacgaacgacctgacgcagatgacctttgggtacagcagggatgatgtggggaagttcattcccgtctatcttgctcagggcatcctccaacatgaccccttcgaggtcctggaccagaggttagtgtgcgagctggtgaagtttgctacagagatgggccgcaaagctaggcctaacttgaaggtgggcatttgtggagaacacggtggagag

SEQ ID NO: 6645 - DNA, 263 bp, Zea mays
  Clone ID: 700427458H1
cggtggagagccttcctctgcggccttcttcgcgaaggctgggctggattacgattcttgctccacctttcagggttccgattgctaggctagctgcagctcaggtgcttgtctgagggtgcctccacattgaaccaccggattgcctgctgatggtggatgtggtgatccacagtatgatcgcagagccatgctatgtgaacattaactagtagcagtgctcataaaagctacaatcccatgtcctttttttccccagtcag

SEQ ID NO: 6646 - DNA, 244 bp, Zea mays
  Clone ID: 700624196H1
attgagatcccagggcagctctggtggctgatgagatagcggacaggctgaattcttctccttcggcacgaacgacctgacgcagatgacctttgggtacagcagggatgatgtggggaagttcattcccgactatcttgctcagggcatcctccaacatgaccccttcgaggtcctggaccagaggggaagtgggcgagctgatgaagtttgctcaaagaggggcctaaaagctaggccaaac

SEQ ID NO: 6647 - DNA, 249 bp, Zea mays
  Clone ID: 700805096H1
gaaatgcaagcccgtgccatctttgaagctgctatagcgatgaccaaccagggcgttcaagtctttccagagataatggttcctcttgttggaacaccgcaggaattgggacatcaggtggcccttatccgtcaagtcgctaacaaagttttcaccagtatggggaaaactattgggtacaagatcggaacgatgattgagattcccagggcagctctagtggctgacgagatcgcggacaggctgaat

SEQ ID NO: 6648 - DNA, 287 bp, Zea mays
  Clone ID: 700042161H1
cgggagccaaccaggaggatgccctcgcacggatcgaaaagctttcggaagtaaacccgatgcttggcttccgtggctgcaggcttggtatatcgtaccctgagctaacagaaatgcaagcccgtgccatctttgaagctgctataacgatgaccaaccagggcgttcaagtctttccagagataatggttcctcttgttggaacaccgcaggaattgggacatcaggtggcccttatccgtcaagtcgctaacaaagttttcaccagtatgggtaaaactattggg

SEQ ID NO: 6649 - DNA, 263 bp, Zea mays
  Clone ID: 700578768H1
ccctgagcaagatagacgggaatgaacttccccacatcatccctgctgtacccaaaggtcatctgcgtcaggtcgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgattatatacgtggcaagtttttttcc

SEQ ID NO: 6650 - DNA, 217 bp, Zea mays
  Clone ID: 700802865H1
aggaaatgctgcgtctcgggatgctaggcattcgcgtaaacgatgcggagaagctcgtgacgatcggaggccatgtgctgcgcgaaggtgagttgctgtcgctgaatgggtcgactggtgaggtgatccttgggaagcagccgctgttccccagcagcccttagtagtgatctgggaacttgcatggtctgggtggatgatgttagaaagctcaagg

SEQ ID NO: 6651 - DNA, 182 bp, Zea mays
  Clone ID: 700580152H1
tgagatagcggacaggctgaattcttctccttcggaacgaacgacctgacgcagatgacctttgggtacagcagggatgatgtggggaagttcattcccgtctatcttgctcagggcatcctccaacatgaccccttcgaggtcctggaccagaggggagtgggcgagctggtgaagtttgc

SEQ ID NO: 6652 - DNA, 245 bp, Zea mays
  Clone ID: 700041938H1
caacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgattatatacgtggcaaaaaaaaaaaaaaaaaaaaaaaaaaaaaaaaaaaaaaaaaaaaaaaaaaaagaaaaagaagaaacagcggaggac

SEQ ID NO: 6653 - DNA, 259 bp, Zea mays
  Clone ID: 700196549H1
ctattgggtacaagatcggaacgatgattgagattcccagggcagctctagtggctgacgagatcgcggacaggctgaattcttctcctttggaacgaacgacctcacgcagatgacctttggctacagcagggatgatgtggggaagttcatccccatttatctggctcagggcatcctccagcatgaccccttcgaggtaactgctgcagctcctctgtcaccctctctcatctgaggccatactcgcatctccatc

SEQ ID NO: 6654 - DNA, 188 bp, Zea mays
  Clone ID: 700425162H1
gatcaacagtattattacagagccatgctatgtgaacattactagtagcagtgctcataaaagctacaatcccatctcccttttttttccagtcatgtaaaacttccaaactgctccatggttcaaaactctgttcttcaatacatcatcaattatcgattaaaaaaaaaaaaaaaaaaagggggggc

SEQ ID NO: 6655 - DNA, 277 bp, Zea mays
  Clone ID: 701160579H1
cggctcgaggcaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaagct

SEQ ID NO: 6656 - DNA, 211 bp, Zea mays
  Clone ID: 700456514H1
tgagctggtgaagcttgctacagataggagccgcaaagctaggcctaacttgaaggtgggcatttgtggagaacacggtggagagccttcatctgtgagcttcttcgcgaaggctgggctggattacgtttcttgatcccctttcgggttccgattgctaggctagctgcagctcaggtgcttgtctgaggctgcctcctcattggaaacc

SEQ ID NO: 6657 - DNA, 180 bp, Zea mays
  Clone ID: 700441507H1
gtgcaggcttggtatatcgtaccctgaattgacagagatgcaagcccgggccatttttgaagctgctatagcaatgacgaacagggtgttcaagtgttcccagagataatggttcctcttgttggaacaccacaggaactggggtcatcaagtgactcttatccgccaagttgctgagaa

SEQ ID NO: 6658 - DNA, 161 bp, Zea mays
  Clone ID: 700099603H1
ctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttg

SEQ ID NO: 6659 - DNA, 250 bp, Zea mays
  Clone ID: 700442758H1
tgctgaggatgctgaagcatggcattcccaagggaaagctgctattctggtaatggcggagaccagccctgatgacgttggtggcatgcacgctgctgtggggattcgtacagagaggggtggcatgacttcccacgctgctgtggtcgcactgggatggggaatgctgcgtctcgggatgctcaagcattcgcgtaaacgatgcggagaagctcgtgacgatcggaggccatgtgctgcgcgaaggtga

SEQ ID NO: 6660 - DNA, 250 bp, Zea mays
  Clone ID: 700804296H1
caacctgggcctcaacgaccaagtggcgccggctggcggcaagagcggggaccgttcgcctacgactccttccgccgcttcctcgacatgttcggcaacgtcgtgatggacatcccccacgcgctgttcgaagagaagcttgaagccatgaagaaagccaaggggctgaagaacgacaccgacctgaccgccaccgacctcaaagagctggtgggccagtacaaggacgtctacgtggaggctaagggag

SEQ ID NO: 6661 - DNA, 183 bp, Zea mays
  Clone ID: 700438664H1
cagcgaggtctacctctcagccaagggagagccattcccctcagaccccaagaagcaggtgggagctagcagtgctggctgtgttaactcgtgggagagccccagggccaagaagtacaggagcatcaaccagatcactggcctcaggggcacgccgtgaacgtgcagtgcatggtgttcggc

SEQ ID NO: 6662 - DNA, 179 bp, Zea mays
  Clone ID: 700441510H1
caggaactggggcatcaagtgactcttatccgccaagttgctgagaaagtgttcgccaatgtgggcaagactatcgggtacaagttggaacaatgattgagatccccagggcagctctggtggctgatgagatagcggacagggctgaattcttctccttcggaagaacgacctgacgc

SEQ ID NO: 6663 - DNA, 188 bp, Zea mays
  Clone ID: 700428514H1
cgcagatgacctttgggtacagcagggatgatgtgggaaagttcattcccgtctatcttgctcagggcattctccaacatgaaccccttcaaggtcctggaccagaggggagtgggcgagctggtgaagcttgctacagagaggggccgcaaagctaggcctaacttgaaggtgggcatttgtggaga

SEQ ID NO: 6664 - DNA, 141 bp, Zea mays
  Clone ID: 700101932H1
gaagaacgacaccgacctcacggcctctgacctcaaagagctcgtgggtcagtacaaggaggtctagctctcagccagaggagagccatctccctcagacgccaagaagcagctggagctcagactgctggctgtgttcaa

SEQ ID NO: 6665 - DNA, 177 bp, Zea mays
  Clone ID: 700262656H1
cttacagagaggggtggcatgacttcccacgctgctgtggtcgacacgtgggtgggggaaatgctgcgtctcgggatgctcaggcattcgcgtaaacgatgcggagaagctcgtgacgatcggaggccatgtactgcgcgaaggtgagttgctgtcgctgaatgggtcgactggtga

SEQ ID NO: 6666 - DNA, 155 bp, Zea mays
  Clone ID: 700583279H1
gtgactcttatccgccaagttgctgagaaagtgttcgccaatgtgggcaagactatcgaggtacaaagttggaacaatgattgagatccccagggcagctctcgtggctgatgagatagcggacaggctgaattcttctccttcggaacgaacga

SEQ ID NO: 6667 - DNA, 121 bp, Zea mays
  Clone ID: 700624652H1
caatgattgagatcccagggcagctctggtggctgatgagatagcggagcaggctgaattcttctccttcggaacgaacgacctgacgcagatgacctttgggtacagcagggatgatgtg

SEQ ID NO: 6668 - DNA, 165 bp, Zea mays
  Clone ID: 700612451H1
cacggatcgaaaagctttcggaagtaaacccgatgcttggcttccgtggctgcaggcttggtatatcgtaccctgagctaacagaaatgcaaggccgtgccatctttgaagctgctataacgatgaccaaccagggcgttcaagtctttccagagataatggttc

SEQ ID NO: 6669 - DNA, 302 bp, Zea mays
  Clone ID: 700335324H1
tatgctgttggtgcatctggtgattaataatactactatgacagagccatgctctgtgaagagtattagtagcagcgctcatacaagctacagttccgtctcttttctcagctatgtaaaacttccaaactgttcatgcttaaaactgagagttttcttggtgtgaggtgtgcatgtcgttgttgaggccattgctgcacattccacctattgaggccctcctcaaattaagcctcgaaaaagctgatatcttttcgtagaactctagactccggtgaatgcaactggctggtttgcttccg

SEQ ID NO: 6670 - DNA, 175 bp, Zea mays
  Clone ID: 700440390H1
gagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttc

SEQ ID NO: 6671 - DNA, 130 bp, Zea mays
  Clone ID: 700097825H1
gcttggcttccgtgggtgcaggcttggtatatcgtaccctgaattgacagagatgcaagcccgggccatttttgaagctgctatagcaatgaccaaccagggtgttcaagtgttcccagagataatggtt

SEQ ID NO: 6672 - DNA, 137 bp, Zea mays
  Clone ID: 701163821H1
tactactatgacagagccatatgctctgtgaagagtattagtagcagcgctcataaaagctacagttccatctattttctcagctatgtaaaacttccaaactgttcatgcttaaaactgagggttttcgtggtgtg

SEQ ID NO: 6673 - DNA, 130 bp, Zea mays
  Clone ID: 700438560H1
cctccacgagttccttccagaagggaacatcgaggacattgtaagtgaattatgtgctgagaccggagccaaccaggaggatgccctcgcgcgaattgaaaagctttcagaagtagacccgaggcctggc

SEQ ID NO: 6674 - DNA, 171 bp, Zea mays
  Clone ID: 700805587H1
ggcgttcaagtctttccagagataatggttcctcttgttggaacaccgcaggaattgggacatcaggtggcccttatccgtcaagtcgctaacaaagttttcaccagtatgggtaaaactattgggtacaagatcgggacgatgattgagattcccagggcagctctagtg

SEQ ID NO: 6675 - DNA, 137 bp, Zea mays
  Clone ID: 700100859H1
cccacgcgtccgctcaaagagctcgtgggtcagtacaaggaggtctacctctcagccaagggagagccattcccctcagaccccaagaaacagctggagctagcagtgctggctgtgttcaactcgtgggagagccc

SEQ ID NO: 6676 - DNA, 266 bp, Zea mays
  Clone ID: 700580595H1
acatgaccccttcgaggtcctggaccagaggggagtgggcgagctggtgaagtttgctacagagagggtgcgcaaagctaggtctaacttgaaggtgggcatttgtggagaacacggtggagagccttcctctgtagcttcttcgcgaagctgggctggattacgtttcttgctcccctttcagggttccgattgctaggctagctgcagctcaggtgcttgtcctgagctgcctcctcattggcaaccggatttctgctgctggt

SEQ ID NO: 6677 - DNA, 180 bp, Zea mays
  Clone ID: 700441529H1
tctggaccctcccctccacgagttccttccagaagggaacatcgaggacattgtaagtgaattatgtgctgagacgggagccaccaggaggatgccctcgcgcgaattgaaaagctttcagaagtaaacccgatgcttggcttccgtgggtgcaggcttggtatatcgtaccctgaattg

SEQ ID NO: 6678 - DNA, 104 bp, Zea mays
  Clone ID: 700045548H1
atcccatctcccttttttttccagtcatgtaaaacttccaaactgctccatggttcaaaactctgttcttcaatacatcatcaattatcgattatatacgtggc

SEQ ID NO: 6679 - DNA, 125 bp, Zea mays
  Clone ID: 700097365H1
cccacgcgtccgagaagcttgagcacatgaaggaatccaaggggctgaagaacgacaccgacctcacggcctctgacctcaaagagctcgtgggtcagtacaaggaggtctacctctcagccaag

SEQ ID NO: 6680 - DNA, 116 bp, Zea mays
  Clone ID: 700424468H1
tgacttcccacgctgctgtggtcgcacgtgggtgggggaaatgctgcgtctcgggatgctcaagcattcgcgtaaacgatgcggagaagctcgtgacgatcggaggccatgtgctg

SEQ ID NO: 6681 - DNA, 187 bp, Zea mays
  Clone ID: 700457633H1
aggctgtggatgttgcagtgcaggacagggaaacgtacgggcaaaagtgccgtgatgatcgccgtggacatggttaacgagggccttgttgagccccgctcagcgatcaagatgggtagacccatgccacctggaccagcttctccatcctcagtttgagaacccgtcggcgtacaaggatcaggtc

SEQ ID NO: 6682 - DNA, 124 bp, Zea mays
  Clone ID: 700425102H1
tccttcgtctgttgccttcttcgcgaaggctgggctggattacgtttcttgctcccctttcagggttccgattgctaggctagctgcagctcaggtgcttgtctgaggctgcctcctcgttggc

SEQ ID NO: 6683 - DNA, 128 bp, Zea mays
  Clone ID: 700097811H1
cccacgcgtccgagcgcttcgcctaagactccttccggcggttcctcgacatgttcggcaacgtcgtcatggacatcccccggtcactgttcgaagagaagcctgagcacatgaagggatccaaaggg

SEQ ID NO: 6684 - DNA, 122 bp, Zea mays
  Clone ID: 700404795H1
cctgaattgacagagatgcaagcccgggccatttttgaagctgctatagcaatgaccaaccagggtgttcaagtgttcccagagataatggttcctcttgttggaacaccacaggaacttgg

SEQ ID NO: 6685 - DNA, 125 bp, Zea mays
  Clone ID: 700431218H1
gtatcgggtacaaagttggaacaatgattgagctccccagggacgctctggtggctgatgagatagcggacaggctgaattcttctccttcggaacgaacgacctgacgcagatgaactttgggc

SEQ ID NO: 6686 - DNA, 122 bp, Zea mays
  Clone ID: 700097835H1
cggacgcgtgggtggacacggtgctcaacctggggctcaacgacgaagtggccgccgggctggcggccaagagcggggagcgcttcgcctacgactccttccgcaccttcctcgacatgttc

SEQ ID NO: 6687 - DNA, 98 bp, Zea mays
  Clone ID: 700100627H1
ctccttccgccgcttcctcgacatgttcggcaacgtcgtcatggacatcccccgctcactgttcgaagagaagcttgagcacatgaaagaatccaaag

SEQ ID NO: 6688 - DNA, 129 bp, Zea mays
  unsure (1)...(129): unsure at all n locations
  Clone ID: 700618263H1
tgcaagcccgtgccatctttgaagctgctatagcgatgaccaaccaaaggcgtcaagtcgttccagagataatggttcgctctggtggaacaccgcaggagattgggacatcangtgggcgctatccgt

SEQ ID NO: 6689 - DNA, 98 bp, Zea mays
  Clone ID: 700583801H1
aattgacagagatgcaagcccgggccatttttgaagctgctatagcaatgaccaactagggtgttcaagtgttcccagagataatggatcctcttgtt

SEQ ID NO: 6690 - DNA, 103 bp, Zea mays
  Clone ID: 700099807H1
cgtgacgcgtgggtcagaccccaagaagcagctggagctagcagtgctggctgtgttcaactcatgggagagccccagggccaagaagtacaggagcattaac

SEQ ID NO: 6691 - DNA, 96 bp, Zea mays
  Clone ID: 700097573H1
cccacgcgtccggccgcttcctcgacatgttcggcaacgtcgtcatggacatcccccgctcactgttcgaagagaagctttagcacattaaggaat

SEQ ID NO: 6692 - DNA, 102 bp, Zea mays
  Clone ID: 700427553H1
gttcaacagtattattacagagccatgctatgtgaacattactagtagcagtgctcataaaagctacaatcccatctcccttttttttccagtcatgtgaaa

SEQ ID NO: 6693 - DNA, 121 bp, Zea mays
  Clone ID: 700098562H1
cacacgcgtccgcacacgcgtccgcccacgcgtccgcccacgcgtccgcccacgcgtccgggacatcccccgctcactgttcgaagagaagcttgagcacatgaaggaatccaaggggctg

SEQ ID NO: 6694 - DNA, 67 bp, Zea mays
  Clone ID: 700799964H1
gccaagagcggggaccgcttcgcctacgactccttccgccgcttcctcgacatgttcggcaacgtcg

SEQ ID NO: 6695 - DNA, 296 bp, Zea mays
  Clone ID: 700266534H1
atttatttgtcactgatcgttgatcagcctagctagctagcgctgttttcctgtgtgctaatggcgcccgttcaatgtgcgcgttcgcagagggtgttccacttcggcaagggcaagagcgagggcaacaagaccatgaaggaactgctgggcggcaagggcgcgaacctggcggagatggcgagcatcgggctgtcggtgccgccagggttcacggtgtcgacggaggcgtgccagcagtaccaggacgccagggtcgccctccccgcggggcgtctgggccgagatcgtcgacg

SEQ ID NO: 6696 - DNA, 272 bp, Zea mays
  Clone ID: 700455813H1
cgcatttatttgtcactgatcgttgatcagcctagctagctagcgctgttttcctgtgtgcgagtggcgcccgttcaatgtgcgcgttcgcagagggtgttccacttcggcaagggcaagagcgagggcaacaagaccatgaaggaactgctgggcggcaagggcgcgaacctggcggagatggcgagcatcgggctgtcggtgccgccagggttcacggtgtcgacggatgcgtgccagcagtaccaggacgccgggtgcgccctccccgc

SEQ ID NO: 6697 - DNA, 115 bp, Zea mays
  Clone ID: 700099255H1
cccacgcgtccgcgaacctggcggagatggcgagcatcgggctgtcggtgccgccaaggttcacggtgtcgacggaggcgtgccagcagtaccaagacgacgggtgcggcctccc

SEQ ID NO: 6698 - DNA, 317 bp, Zea mays
  Clone ID: 700098424H1
ctcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaatccgccggcgtcatcc

SEQ ID NO: 6699 - DNA, 296 bp, Zea mays
  Clone ID: 700099971H1
cagctccgttggagctccggacagcagcaagcgcggggcggtcacgtagtaagcagctctcggctccctctccccttgctccatatgatcgtgcaacccatcgagctacgcgcgtggactgccttccctgggtcggcgcaggaggggattcggaaggatgacggcatcggtttccaggggcatctgcgtacagaagccgggctcaaaatgcaccagggacagggaagcgacctccttcgcccgccgatcggtcgcagcgccgaggcccccgcacggcaaagtccgcggcgtcatcc

SEQ ID NO: 6700 - DNA, 263 bp, Zea mays
  Clone ID: 700044869H1
agctcactcgccacacacacaccccctctccagctccgttggactccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcatcggtttccagggccatctgcgttcagaagccgggctcaaaatgcaccagggacagggaagcgacctcc

SEQ ID NO: 6701 - DNA, 310 bp, Zea mays
  Clone ID: 700097037H1
gccgggctcaaaatgcaccagggacagggaagcgacctccttcgcccgccgatcggtcgcagcgccgaggcccccgcacgccaaagccgctcgcgtcatccgctccgactccggcgcgggacggggccagcattgctcgccgctgagggccgtcgttgacgccgcgccgatacagacgaccaaaaagagggtgttccacttcggcaagggcaagagcgagggcaacaagaccatgaaggaactgctgggcggcaagggcgcgaacctggcggagatggcgagcatcgggctgtcggtgccgctggggttc

SEQ ID NO: 6702 - DNA, 313 bp, Zea mays
  Clone ID: 700095363H1
cacaccccctctccagctccgttggagctccggacagcagcaggcgcggggcggtcacgtagaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccagaaagagggtgttccac

SEQ ID NO: 6703 - DNA, 316 bp, Zea mays
  Clone ID: 700101364H1
cggcggcggtttccagggccatctgcgtccagaaaccgggctccaaatgcagcagggacagggaagcgacctccttcgcccgccgaacggtcgcggcgccgaggcccccgcgcgccaaagccgccggcgtcatccgctccgactccggcgcgggacggggccagcagtgctcgccgctgagggccgtcgttgacgccgcgtcgatacagacgaccaaaaaggctgcagcagctgccacccccgcgccacatggacgcacggtggacggtgctctgcctctcccgcgaacgccgtgaccgggtactagctagcttag

SEQ ID NO: 6704 - DNA, 317 bp, Zea mays
  Clone ID: 700101568H1
gcggcggcggtttccagggccatctgcgtccagaaaccgggctccaaatgcagcagggacagggaagcgacctccttcgcccgccgaacggtcgcggcgccgaggcccccgcgcgccaaagccgccggcgtcatccgctccgactccggcgcgggacggggccagcagtgctcgccgctgagggccgtcgttgacgccgcctcgatacagacgaccaaaaagagcaaatggcgcctcagtctcccgcgcgcaagctacaacggttcagggtccggtgctgcggcggctgagccgtctaccgtgggagacaccttgga

SEQ ID NO: 6705 - DNA, 210 bp, Zea mays
  Clone ID: 700045180H1
cggctccctctccccttggtccatatgatcgtgcaacccatcgagctacgcgcgtggactggctttcctgggtcggcgcaagaagggatcggaaagatggcggcatcggtttccagggccatctgcgttcagaagccgggctcaaaatgcaccagggacagggaagcgacctccttcgcccgccgatcggtcgcagcgccgaggcccccg

SEQ ID NO: 6706 - DNA, 236 bp, Zea mays
  Clone ID: 700042559H1
gcggcggtttccagggccatctgcgtccagaaaccgggctccaaatgcagcagggacagggaagcgacctccttcgcccgccgaacggtcgcggcgccgaggcccccgcgcgccaaagccgccggcgtcatccgctccgactccggcgcgggacggggccagcagtgctcgccgctgagggccgtcgttgacgccgcgtcgatacagacgaccaaaaagagcaaatggcgcctcag

SEQ ID NO: 6707 - DNA, 173 bp, Zea mays
  Clone ID: 700045393H1
cggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggggca

SEQ ID NO: 6708 - DNA, 117 bp, Zea mays
  Clone ID: 700099658H1
ggcggcggtttccagggccatctgcgtccagaaaccgggctccaaatgcagcagggacagggaagcgacctccttcgcccgccgaacggtcgcggcgccgaggcccccgcgcgccaa

SEQ ID NO: 6709 - DNA, 406 bp, Zea mays
  unsure (1)...(406): unsure at all n locations
  Clone ID: LIB143-024-Q1-E1-F11
caggagccaaccaggaggatgccctcgcgcaaattgaaaacctttcaaaagtaaacccgatgcttggcttccttgggtgaaggcttggaaaaccgtaccctgaattgacaaaaatgcaagcccgggcaatttttgaacctgcaatagaaatgacaaaccagggtgtcaaattgtcccaaaaaataagggtcccccttgttggaacaacacaggaactggggcatcaagtgactcttatccgcaaagttgctgagaaagtgttcgcaaatgtgggcaagactatcgggtacaaagttggaacaatgattgagatcccaaggcaactctgggggctgatgagataacggagcaagctgaattcntctccttcggaacgaacgacctgacgcagattacctttgggtac

SEQ ID NO: 6710 - DNA, 108 bp, Zea mays
  Clone ID: LIB3059-017-Q1-K1-F2
caggaattgggacatcaggtggcccttatccgtcaagtcgctaacaaagttttcaccggtatgggtaaaactattgggtaccagatcgggaccattattgagatttcc

SEQ ID NO: 6711 - DNA, 148 bp, Zea mays
  Clone ID: LIB3059-022-Q1-K1-D6
tcgaccacgcgtacgaggacgcgtgggggatgtagtgatcaacggtgttattacagaggcatgctatgtgaacattactagtagcagtgctcataaaagctacaatcccatgtacctgtatttgcccagtcatgtatacacttccaaa

SEQ ID NO: 6712 - DNA, 272 bp, Zea mays
  Clone ID: LIB3059-032-Q1-K1-G4
tcgtcgcacgcgttcggtcactcctaccggtaccctgggctaacataaatgccagcccgtggcagcgtttaagctgctatagcgatgaccaaccagggcgttcaagtctttccagagataatggttcctcttgttggatcacctcatgaattgggacatcaagtggcccttatccgtcaagtctctaactaagttttcaccagtatggggaaaactattgcgtacatgatcggaacgatgactgagattctcagggcagctctagcggctta

SEQ ID NO: 6713 - DNA, 382 bp, Zea mays
  Clone ID: LIB3059-056-Q1-K1-G11
aggacgcgtgggcggacgcgtggctatatctggctcagggcatcctccagcgtgacccgtgctaggttctcgaccagagatgaatgggccagctggttaagcttgctacagacaggggctagcaaagctaggcctaacttgaacgtggacattggtggagaacatggtggagagcctcaatcggtagctttattcgccaagactgggctggattacgttgctcgctcccttatcagggtcccgatcgctatgctagctgcatatcatgtgccagtctgagggtgcctctgttaggtcgcagccggatcacctgctggtgctacatgtgatgaatcatgatactactatgacagagccatgctactgtgagagcatcagtagc

SEQ ID NO: 6714 - DNA, 304 bp, Zea mays
  Clone ID: LIB3059-054-Q1-K1-F4
tgtccgtgctatggatggactctcattgactattcgacttctggaccctcccctccgctagttcctaccagaagggaacgtcgaggaaatcgtgcgtgaactgtgttctgagacgggagccaaccaggaggatgccctcgcacggatcgaaaagctttcggaagtaaacccgatgcttggcttccgtggctgcaggcttggtatatcgtaccctgagctaacataaatgcaagcccgtgccatctttgaagctgctatagcgatgaccaaccatggctttcaagtcttttcaggggggaatgtt

SEQ ID NO: 6715 - DNA, 440 bp, Zea mays
  unsure (1)...(440): unsure at all n locations
  Clone ID: LIB3060-018-Q1-K1-B4
gtcgacggcctgcaacgggtggaggagtccatgggcgccacgctgggcgatccgcagggcccgctcctgctctccgtccgctccggcgccgccgtgtccatgcccggcatgacggacacggcgctcaacctggggctcaacgacgaagtggccgccgcgctggcggtcaagagcggcgagcgcttcgcctacgactgcttccgccgcttcctcgacatgttcggcaacgtcgccatggacatgccccgctcactgttcgcagagaagcttgagcacatgaaggaatgcaaggggctgaataacgacaccgacctcacggcctctgacctcanagagcttgtgggtcagtacacggaagtctacctctcagccataggagagccattcccctcagaccccatgaagcagctggagctagcagtgctggctgcgttcaactc

SEQ ID NO: 6716 - DNA, 324 bp, Zea mays
  Clone ID: LIB3060-014-Q1-K1-C6
acgctcgccttttcactggactcactcgccatacacaccctctctccagctccgttcgagcgcctagcagcatcatgcgcggggcggtcacgtagtaagcaactctcggctccctctccccttgctccatatgatcgcgcaacccatcaagctacacgcgtggactgccttccctgcgtcggaacattacgggatcgcaaggatgcctgcgtcggtctacaaagccatctgcttacaaaaaccgcgctcaaaacgcaccaatgacagagaagcgacctccttcgcccgccgatcggactcaacgccgaggcccccacacgccaa

SEQ ID NO: 6717 - DNA, 316 bp, Zea mays
  Clone ID: LIB3060-017-Q1-K1-B1
tccgtgcgactccctcaatggtcgagagtccttggcgccaaccttggccaatcccaggccccgctcctgctttccgttcgctccggcgccgccgtgtccatgcccggcatgatggacactgtgctcaacctgcggctcaacgacgaagtggccgccgggctggcggtcaagagcggcgagcgcttcgcctacgactgcttccgccgcttcctcgacatgttcggcaacctcgtcatggacatcccccgctcactgttcgaagagaagcttgagcacatgaaggaatccaaggggctgaagaacgacaccgacctta

SEQ ID NO: 6718 - DNA, 419 bp, Zea mays
  Clone ID: LIB3060-045-Q1-K1-E12
gaccaacccttccgattttaacctttcggttgtactaactggcaaaaaaaaccccttttccagttccgtgggagctccggccagcagcaggccccggccggtcacgtataaacatttttgggttccttttaacccttggttgcataatgatcggggcaacccatcgaagctaccccccggtggactgggctttccctggggtcgggcgcatggacggggatcggaaaggatggcaaggttcgggatttccagggcgcattctgcggttcagaaagcccgggctcaaaatgcaccagggacagcgaagcgacctcctttcgaccggcgatcggtcgcagcgccgatgcccccgcacgccaaagccgccggcgtcatacgctccgactccggcgcgggacggcgccagcattgctcgccgc

SEQ ID NO: 6719 - DNA, 327 bp, Zea mays
  Clone ID: LIB3060-036-Q1-K1-H4
cttccttacgcgaactatgtattctttaatacacgagtatcctttcagaagggaacgttgattacattgttagtgaattatgtcctgagactccatccaaccaccaagattccctcgctcgaattgaaaagctttcacaagtaaacccgatgcttggcttacgtgggtacaggcttggtatatcataccctgaattgacagagatgcaagcccgtaccatttttgaagctgctatagcaatgaccaacctatgtgttcaagtgttcccagacataatgcttactcttgttggaacaccacagtaacttgggcatcaagtgactctta

SEQ ID NO: 6720 - DNA, 60 bp, Zea mays
  unsure (1)...(330): unsure at all n locations
  Clone ID: LIB3060-050-Q1-K1-D5
acggaggctcnttgattatgaggcctagtnactanagttcagttcaggttagtaatgact

SEQ ID NO: 6721 - DNA, 330 bp, Zea mays
  Clone ID: LIB3061-002-Q1-K2-D12
gctaggcctaacttgaacgtgggcatctgaggagaacatggtcgagagccttcatcggttgctctcttcgtcaagtactgtgctggattacgtgtgttgctcccctttcaaggtcccgatcgctatgctagctgcagctcacgtgcttgtctgagggtgcctttgctcgatggcagtcggatctgctgctgacggtgcatgtggtgatttacaatactactatgacagagccatgctctgtgaaaagtattagtagcatggctcataaaagctacagttccgtatattttctcagctatgtaaaactttcaaactgctcatgcttaaaac

SEQ ID NO: 6722 - DNA, 354 bp, Zea mays
  Clone ID: LIB3061-042-Q1-K1-H11
cttggaggtgggcatttgtggagaacacggtggagagccttcctctgtggccttcttcgcgaaggctggcctgggtccgttcctggttcccttttcagggttccgattgctaggctagctgcagctcaggtccttgccttaggctgcctcctaattggcaaccggtttgcctgcttctggggaattgggggtccacccgtttttttcccagaccctccctttgaacccttctctggtcccagctcttttaagctttccatccctatgcctttttttccccaacctgtttaactttctcactctgctccacggtttcaaatctgttctttaaaacaccatctcctatcaccgttt

SEQ ID NO: 6723 - DNA, 376 bp, Zea mays
  Clone ID: LIB3078-051-Q1-K1-G3
acgactcgttcgacatgatcatggactgctgcactcgatctgaggcagcacgcgctcgggcctgtcttgacgtatcagagggcggacttctaaagcatcttccacactctgtatgcactcccggataccatgcgactcctggaccctactctccaccagttccttccacaagggaacatcgactacattgtaactgaatgatctgctgagaccgtagccaaccatgaggataccctcgcgcgaatcgacaaactttcaaaagtaaacccaacgcttggcatccgagactgcaggctcggtatatcgtgccctgcatcgacaaagacgcaaactccctccatctttgaagctgctatcgcaatgaccaaccaaagtg

SEQ ID NO: 6724 - DNA, 312 bp, Zea mays
  Clone ID: LIB3078-011-Q1-K1-B7
gtgatgatgcattgactgcgccaaattatgaggcacaaggaattggattatgccgtgcagagcacatgttctttgctggagacgatacgattaaggctgtcaggcaaatgattatggctcccacgtttgagctgaagcatcatgcgctcgaccgtctcttgccgtatcagaagtctgacttcgaaggcattttcactgctatggatggactacctgttaccatccgactcctggaccctctcctctacgagttcctttcagaagggaacatcgtagacattgtcagtgaattctgtgctgagactgtagcca

SEQ ID NO: 6725 - DNA, 368 bp, Zea mays
  Clone ID: LIB36-020-Q1-E1-A10
acacactgaccacggcttacaccgattcccctgaagatgcatcgactgcacgaaacactggggcacaatgcattggattatgccggacagagcacatgttctttgcttcagacgataggattaaggctgtcacgcagatgattatagctcccacgcttgagctgaagcatcaggcgctccaccgtctcttgccgtatcacaggtctgacttccactgcattttccgtgctatggagtggactcccggtgactatccgacacctggaccctcccctccacgagttccttccagaagggaacatcgatgacattgtccatgaattatgtcctgagacgggagcctgccaggatgattccctcgcgcgaat

SEQ ID NO: 6726 - DNA, 381 bp, Zea mays
  Clone ID: LIB36-005-Q1-E1-D11
atccacgacgtctgcccagcgcatcggaatgacgtgtgcatatgccaggacagagcagatgttcgcttgcttcagatgagaggataaatgctcttacgcacaacattatggctcttacacattatctgatagcatcaagctctcgagcgttccttgcacgtagtagatgtctgacatcgaactgcattttccgtgctatggatggactcccggtgaccatcttactccagcaggctctactccaagagttccttccacaatggaacatccaagacattgtacatcaagtatgtgcagagacaggagccatgtatcaggatactctcccgcgaagttataatcgttcagaactaacatcagacgcttggcttccatgggtgc

SEQ ID NO: 6727 - DNA, 270 bp, Zea mays
  Clone ID: LIB36-007-Q1-E1-F2
gggtcggccgaactggtcgctgtgcgtgcacgtcggaactccagggtcgacctgagcgtccgctcaagcgtacgcccacgcgtccgggcattttccgtgctatggatggactcccggtgaccatccgactcctggaccctcgcctccacgagttccttccagaaggggaaatcgaggagattgtcggtgaagtgcctgctgagaccggagccacgccagtggaggccctcgcgcgaagtgaagaccgttcagaagttcacgctatgcgtg

SEQ ID NO: 6728 - DNA, 130 bp, Zea mays
  unsure (1)...(130): unsure at all n locations
  Clone ID: LIB83-009-Q1-E1-E9
ggnnnnnngtaantgttangccgncttcacaggcctaagactcgcggaatcgacncacgcctctngnntgantnctattatgctccatggttcaaaactctgttcttcaatacatcatcaattatcgatt

SEQ ID NO: 6729 - DNA, 187 bp, Zea mays
  unsure (1)...(187): unsure at all n locations
  Clone ID: LIB83-010-Q1-E1-B1
gtgacgatcggaggccatgtgctgcgcgaaggtgagtggctgtcgctgaatgggtcgactggtgaagtgatccttggggaancagncggctttccccacnagccctnagtggtnatcngggaanttccatgncctgggtgnataannttanaaanctnaaggtccngncnaatccganncccngnna

SEQ ID NO: 6730 - DNA, 453 bp, Zea mays
  Clone ID: LIB36-016-Q2-E2-E10
gagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtggggaagttcattcgcgtctatcttgct

SEQ ID NO: 6731 - DNA, 435 bp, Zea mays
  Clone ID: LIB3060-003-Q1-K1-C3
ctgacctcaaagagctcgtgggtcagtacaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcaccaggaaccccaacaccggagagaagaagctgtatggcgagttcctggtgaacgctcagggtgaggatgtggttgccggaataagaaccccagaggaccttgacgccatgaagaacctcatgccacaggcctacgacgagcttgttgagaactgcaacatcctggagagccactacaaggaaatgc

SEQ ID NO: 6732 - DNA, 437 bp, Zea mays
  Clone ID: LIB3078-052-Q1-K1-H5
gtgaattatgtgctgagacgggagccaaccaggaggatgccctcgcgcgaattgaaaggctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgat

SEQ ID NO: 6733 - DNA, 458 bp, Zea mays
  Clone ID: LIB3078-033-Q1-K1-A12
cccacgcgtccggttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccaattttgaagctgctatagcaatgaccaaccagggtgttcaagtgttcccagagataatggttcctcttgttggaacaccac

SEQ ID NO: 6734 - DNA, 464 bp, Zea mays
  unsure (1)...(464): unsure at all n locations
  Clone ID: LIB36-016-Q2-E2-C3
cccaagcgtccgcattgccactggtctgccagcctcacctggggctgctgtgggccaggttgtgttcactgctgaggatgctgaagcatggcattcccaagggaaagctgctattctggtaagggcggagaccagccctgaggacgttggtggcatgcacgctgctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgngtggatgatgttagaaagctcaaggtcctggctaacgccgata

SEQ ID NO: 6735 - DNA, 431 bp, Zea mays
  Clone ID: LIB3060-054-Q1-K1-E4
ctcagtttgagaacccgtcggcgtacaaggatcaagtcattgccactggtctgccagcctcacctggggctgctgtgggccaggttgtgttcactgctgaggatgctgaagcatggcattcccaagggaaagctgctattctggtaagggcggagaccagccctgaggacgttggtggcatgcacgctgctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctggga

SEQ ID NO: 6736 - DNA, 462 bp, Zea mays
  unsure (1)...(462): unsure at all n locations
  Clone ID: LIB36-016-Q2-E2-C5
cccacgcgtccgcattgccactggtctgccagcctcacctggggctgctgtgggccaggttgtgttcactgctgaggatgctgaagcatggcattcccaagggaaagctgctattctggtaagggcggagaccagccctgaggacgttggtggcatgcacgctgctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatgggctgngtggatgatgttagaaagctcaaggtcctggctaacgccgg

SEQ ID NO: 6737 - DNA, 453 bp, Zea mays
  Clone ID: LIB36-014-Q1-E1-D2
gcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgc

SEQ ID NO: 6738 - DNA, 434 bp, Zea mays
  Clone ID: LIB3059-058-Q1-K1-A12
gcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattac

SEQ ID NO: 6739 - DNA, 440 bp, Zea mays
  Clone ID: LIB3060-006-Q1-K1-C1
cttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaagcgct

SEQ ID NO: 6740 - DNA, 429 bp, Zea mays
  Clone ID: LIB3060-016-Q1-K1-F8
gctcaacctggggctcaacgacgaagtggccgccgggctggcggccaagagcggggagcgcttcgcctacgactccttccgccgcttcctcgacatgttcggcaacgtcgtcatggacatcccccgctcactgttcgaagagaagcttgagcacatgaaggaatccaaggggctgaagaacgacaccgacctcacggcctctgacctcaaagagctcgtgggtcagtacaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgtcgtgaacgtgcagtgcatggtgttcggcaacatggggaacacttc

SEQ ID NO: 6741 - DNA, 422 bp, Zea mays
  Clone ID: LIB3060-045-Q1-K1-E3
cgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattga

SEQ ID NO: 6742 - DNA, 408 bp, Zea mays
  Clone ID: LIB3060-026-Q1-K1-D6
ggttgccggaataagaaccccagaggaccttgacgccatgaagaacctcatgccacaggcctacgacgagcttgttgagaactgcaacatcctggagagccactacaaggaaatgcaggatatcgagttcactgtccaggaaaacaggctgtggatgttgcagtgcaggacagggaaacgtacgggcaaaagtgccgtgaagatcgccgtggacatggttaacgagggccttgttgagccccgctcagcgatcaagatggtagagccaggccacctggaccagcttctccatcctcagtttgagaacccgtcggcgtacaaggatcaagtcattgccactggtctgccagcctcacctggggctgctgtgggccaggttgtgttcactgctgaggatgctgaagcatg

SEQ ID NO: 6743 - DNA, 413 bp, Zea mays
  Clone ID: LIB3060-012-Q1-K1-A7
gctgatacgggagccaaccaggagatgccctcgcgcgaattgaaaagctttcagagagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtggtcaagactatcgggtacaaagttggaacaatgattgatatccccagggcagctctggtggctgatgagatagcggatcaggctgaattcttctccttcggaacgaacgacctgacccagatgacctttgggtt

SEQ ID NO: 6744 - DNA, 408 bp, Zea mays
  Clone ID: LIB83-003-Q1-E1-G2
agttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctc

SEQ ID NO: 6745 - DNA, 420 bp, Zea mays
  Clone ID: LIB143-022-Q1-E1-G5
agggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatg

SEQ ID NO: 6746 - DNA, 427 bp, Zea mays
  unsure (1)...(427): unsure at all n locations
  Clone ID: LIB3060-044-Q1-K1-F6
gttcaactcgtgggagagccccagggccaagaagtacaggagcatcaaccagggcggtggcctcaggggcaccgccgtgaacgtgcagtgcatggtgttcggcaacatggggaacacttctggcaccggcgtgctcttcactaggaaccccaacaccggagagaagaagctgtatggcgagttcctggtgaacgctcagggtgaggatgtggttgccggaataagaaccccagaggaccttgacgccatgaagaacctcatgccacaggcctacgacgagcttgttgagaactgcaacatcctggagagccactataaggaaatgcaggatatcgagttcactgtccagganaacaggctgtggatgttgcagtgcaggacaggggaacgtacgggcaaaagtgccgtgaagatcgccgtggacatg

SEQ ID NO: 6747 - DNA, 409 bp, Zea mays
  Clone ID: LIB3060-025-Q1-K1-B10
gcgcaggcattcgcgtaaacgatgcggagttagctcgtgacgatcggaggccatgtgctgggcgaaggtgagtggctgtcgctgaatgggtccactggcgaggtgatccttggaaagcagtcgatttccccaccagcccttagtggcgatctgggaactttcatggcctgcgtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaagcgctcgaccgtctcttgccgtatcagaggtctgacttcgaaggcattt

SEQ ID NO: 6748 - DNA, 421 bp, Zea mays
  Clone ID: LIB36-005-Q1-E1-C7
gagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgcccttgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttg

SEQ ID NO: 6749 - DNA, 409 bp, Zea mays
  Clone ID: LIB3060-052-Q1-K1-D5
catgacttcccacgctgctgtggtcgctcgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctg

SEQ ID NO: 6750 - DNA, 422 bp, Zea mays
  Clone ID: LIB3059-024-Q1-K1-F6
caagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctccccttt

SEQ ID NO: 6751 - DNA, 441 bp, Zea mays
  Clone ID: LIB36-002-Q1-E1-B10
cccaagcgtccgcccacgcgtccgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcatgcgctcgaccgtctcttgccgtatc

SEQ ID NO: 6752 - DNA, 431 bp, Zea mays
  Clone ID: LIB3060-052-Q1-K1-E8
cccacgcgtccggtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagc

SEQ ID NO: 6753 - DNA, 412 bp, Zea mays
  Clone ID: LIB3060-016-Q1-K1-G8
tgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgcgtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgact

SEQ ID NO: 6754 - DNA, 417 bp, Zea mays
  Clone ID: LIB84-004-Q1-E1-C3
gagataatggttcctcttgttggaacaccacaggaactggggcatcaagtgagtcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcacggatgatgtggggaagttcattcccgtctatcttgctcagggcatcctccaacatgaccccttcgaggtcctggaccagaggggagtgggcgagctggtgaagtttgctacagagaggggccgcaaagctatgcctaacttgaacgtgggcatttgtggagaacacggtggagagccttcctct

SEQ ID NO: 6755 - DNA, 411 bp, Zea mays
  Clone ID: LIB3060-051-Q1-K1-E9
ctcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatcccc

SEQ ID NO: 6756 - DNA, 430 bp, Zea mays
  unsure (1)...(430): unsure at all n locations
  Clone ID: LIB84-013-Q1-E1-A5
gccaggttgtgttcactgctgaggatgctgaagcatggcattcccaagggaaagctgctattctggtaagggcagagaccagccctgaggacgttggtggcatgcacgcagctgtggggattcttacagagaggggtggcatgacttcccacgctgctgtggtcgcacgtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgnataccctgatgatgcattgac

SEQ ID NO: 6757 - DNA, 426 bp, Zea mays
  Clone ID: LIB3078-002-Q1-K1-E2
agccttcggttgggtttatcgtaccctgaatggacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtg

SEQ ID NO: 6758 - DNA, 423 bp, Zea mays
  unsure (1)...(423): unsure at all n locations
  Clone ID: LIB189-006-Q1-E1-G6
agcggacgcgtggggggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatcnccaaggcagctctggtggctgatgagatagcggagcaggctgaattcttctcct

SEQ ID NO: 6759 - DNA, 448 bp, Zea mays
  unsure (1)...(448): unsure at all n locations
  Clone ID: LIB3060-044-Q1-K1-F8
ggttcctcttgttggaacaccacaggaactggggcatcaagtgactcttatgcgcggggttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtggagaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcctctgtggccttcttcgcgaaggctgngctggattacgtttct

SEQ ID NO: 6760 - DNA, 411 bp, Zea mays
  Clone ID: LIB36-004-Q1-E1-B11
aaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgt

SEQ ID NO: 6761 - DNA, 438 bp, Zea mays
  unsure (1)...(438): unsure at all n locations
  Clone ID: LIB3078-013-Q1-K1-H10
cccacgcgtccgcggacgcgtgggtgatgagatagcggagcaggctgaattcttctcctgcggaacggacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaggtgcttgtctgaggctgcctnctcgttggcaaccggattgcctgctgctggtggatgtggtgatcaac

SEQ ID NO: 6762 - DNA, 417 bp, Zea mays
  Clone ID: LIB36-015-Q1-E1-F9
cccacgcgtccgcccacgcgtccgcccacgcgtccggtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaa

SEQ ID NO: 6763 - DNA, 398 bp, Zea mays
  Clone ID: LIB189-020-Q1-E1-G9
aggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaggtgcttgtctgaggctgcctcctcgttggcaaccggattgcctgctgctggtggatgtggtgatcaacagtattattacagagccatg

SEQ ID NO: 6764 - DNA, 400 bp, Zea mays
  Clone ID: LIB36-004-Q1-E1-F10
accacgcgtccggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggag

SEQ ID NO: 6765 - DNA, 435 bp, Zea mays
  unsure (1)...(435): unsure at all n locations
  Clone ID: LIB3060-005-Q1-K1-B6
tcgatgcacctcgcgccgaattgggaaaagctttctagaagtcaaacgccgatagcttggctttccgatgggtgccaggctatggtattgatcgtaccctgaattgacangagatgcaagncccggtgccattctttgaagctgctatagcaatngaccaaccagggntgttcaagctgttcccangagataatggcttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacaacagggattatgtggggaa

SEQ ID NO: 6766 - DNA, 384 bp, Zea mays
  Clone ID: LIB3060-052-Q1-K1-H7
atcggaggccatgtgctgcgcgaaggtgagtggctgtcgctgaatgggtcgactggtgaggtgatccttgggaagcagccgctttccccaccagcccttagtggtgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatgga

SEQ ID NO: 6767 - DNA, 400 bp, Zea mays
  Clone ID: LIB189-007-Q1-E1-G11
aggggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacct

SEQ ID NO: 6768 - DNA, 417 bp, Zea mays
  unsure (1)...(360): unsure at all n locations
  Clone ID: LIB83-006-Q1-E1-C7
cccacgcgtccgcccacgcgtccggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtggggaagttcattcncgtctatcttgctcagggcatcctccaaacatgaccctt

SEQ ID NO: 6769 - DNA, 427 bp, Zea mays
  unsure (1)...(427): unsure at all n locations
  Clone ID: LIB189-009-Q1-E1-G9
acagagatgcaagcccgggccatttttgaagctgctatagcaatgaccaaccaaggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcncgtctatcttgctcagggcattctccaacatgaccccttcgaggtcctggaccagaggggagtgggcgagctggtgaagcttgctacagagaagggcc

SEQ ID NO: 6770 - DNA, 385 bp, Zea mays
  Clone ID: LIB3060-036-Q1-K1-H3
ctcccggtgaccatgcgactcctggaccctcccctccacgagttccttccagaagggaacattgaggacattgtaagtgaattatgtgctgagacgggagccaaccaggaggatgccctcgcgcgaattgaaaagctttcagaagtaaacccgatgcttggcttacgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtaca

SEQ ID NO: 6771 - DNA, 400 bp, Zea mays
  unsure (1)...(400): unsure at all n locations
  Clone ID: LIB189-013-Q1-E1-D10
cacacgcatccgggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcncgtctatcttgctcagggcatcctcnaacatgacccct

SEQ ID NO: 6772 - DNA, 378 bp, Zea mays
  Clone ID: LIB36-014-Q1-E1-D12
ctatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctctgtggccttcttcgcgaaggctgggctggattacgtttcttgctcccctttcagggttccga

SEQ ID NO: 6773 - DNA, 406 bp, Zea mays
  Clone ID: LIB3078-055-Q1-K1-E2
gggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttctgcaatgtgggcaagactatcgggtacaaagttggaacaatgattgagatccccagggcaactcttgtggctgatgaaatagcggagcaggctgaattcttct

SEQ ID NO: 6774 - DNA, 391 bp, Zea mays
  Clone ID: LIB3060-004-Q1-K1-D9
cgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggacccatccctccacgagtt

SEQ ID NO: 6775 - DNA, 394 bp, Zea mays
  Clone ID: LIB189-020-Q1-E1-G4
agtccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaggtgcttgtctgaggctgcctcctcgttggcaaccggattgcctgctgctggtggatgtggtgatcaacagtattattacagagccatgctatgtgaacattactagtagcagtgcccataaaagctacaatcccatctcccttttttttcagtcatgtaaaacttccaaac

SEQ ID NO: 6776 - DNA, 444 bp, Zea mays
  Clone ID: LIB3060-008-Q1-K1-D10
cggagaagctcgtgacgatcggaggccatgtgctgcgcgaaggtgagtggctgtcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaagctggcatgcagatgattatggctcccacgcttgagctgaggcagcaggcgctcgaccggctcttgccgtatcagaagtctgacttcgaaggcattttacgcgctatggatggactcccggtgaccatctcactcctggacccttcccttcacgagt

SEQ ID NO: 6777 - DNA, 419 bp, Zea mays
  unsure (1)...(419): unsure at all n locations
  Clone ID: LIB189-008-Q1-E1-B5
agcccacgcgtccgcccacgcgtccgcgagctggtgaagcttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtccttttttttccccagtcatgtaaaacttccaaactgctccatggttcaaaactctgttcntcaatacatcatcaat

SEQ ID NO: 6778 - DNA, 401 bp, Zea mays
  unsure (1)...(401): unsure at all n locations
  Clone ID: LIB3059-040-Q1-K1-E1
cttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaagtgcttgtctgaggctgcctnctcggtgggcaaccgaatggcctgctgctgggtggatgtggtgatcaacagtattattacagagccatgctatgtgaacattactagtagcaatgctcataaaagctacaatcccatcttccttttttttccagtcatgtaaa

SEQ ID NO: 6779 - DNA, 428 bp, Zea mays
  Clone ID: LIB3078-051-Q1-K1-G2
cccacgcgtccgagatgattatggctcccacgcttgagctgaggcagcaggcgctcgagcgtgtcttgccgtatcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatgggttctctgtgggacaccacagaactgggc

SEQ ID NO: 6780 - DNA, 381 bp, Zea mays
  Clone ID: LIB84-029-Q1-E1-E6
acccacgcgtccgcgctgaatgggtcgactggtgaggtgatccttggaaagcagccgctttccccaccagcccttagtggcgatctgggaactttcatggcctgggtggatgatgttagaaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactc

SEQ ID NO: 6781 - DNA, 413 bp, Zea mays
  Clone ID: LIB36-004-Q1-E1-D1
gcaatgaccaaacagggtgttcaagtgttcccagagataatggttcctcttgttggaacaccacaggaactggggcatcaagtgactcttatccgccaagttgctgagaaagtgttcgccaatgtgggcaagactatcgggtacaaagttgggacaatgattgagatccccagggcagctctggtggctgatgagatagcggagcaggctgaagtcttctccttcggaacgaacgacctgacgcagatgacctttgggtacagcagggatgatgtggggaagttcattcgcgtcgatcttgcttagggcatcctccaagatgaccccttcgaggtcggtggccggagggcagtgggcgaacgggaagtttgcacagagaggggcgcaaagcaggcctaacttgaagtgggcat

SEQ ID NO: 6782 - DNA, 417 bp, Zea mays
  Clone ID: LIB3059-012-Q1-K1-D10
gtcgctaacaaagttttcaccagtatggggaaaactattgggtacaagatcggaacgatgattgagattcccagggcagctctagtggctgacgagatcgcggagcaggctgaattcttctcctttggaacgaacgacctcacgcagatgacctttggctacagcagggatgatgtggggaagttcatccccatttatctggctcagggcatcctccagcatgaccccttcgaggttctcgaccagagaggagtgggcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcaaggtcccgatcgct

SEQ ID NO: 6783 - DNA, 390 bp, Zea mays
  Clone ID: LIB3059-044-Q1-K1-E2
ggcgttcaagtctttccagagataatggttcctcttgttggaacaccgcacgaattgggacatcaggtggcccttatccgtcaagtcgctaacaaagttttcaccagtatgggtaaaactattgggtacaagatcgggacgatgattgagattcccagggcagctctagtggctgacgagatcgcggagcaggctgaattcttctcctttggaacgaacgacctcacgcagatgacctttggctacagcagggatgatgtggggaagttcatcctcatttatctggctcagggcatcctccagcatgaccccttcgaggttctcgaccagagaggagtgggcgagctggttaagctcgctacagagaggggccgcacagctaggcctaac

SEQ ID NO: 6784 - DNA, 387 bp, Zea mays
  Clone ID: LIB3059-043-Q1-K1-F7
gcacatgtgctttgcttcagactagaggattaaggctgtcaggcagatgattatggctcccactcttgagctgaggcagcaggcgctcgaccgtctcttgccgtatcagaggtctgacttcgaaggcattttccgtgctatggatggactcccggtgaccatccgactcctggacccttgcctccacgagttccttccagaagggaacatcgaggacattgtaagtgaatgatgtgctgagacaggagccaaccaggaggatgccctggcgcgaatagaaaagcttccagaagtgaacccgacgcttggcttacgtgggtgcaagcttggtatatcgtaccctgaattgacagatattcaagcccgggccatttctgaagctgctat

SEQ ID NO: 6785 - DNA, 431 bp, Zea mays
  Clone ID: LIB189-008-Q1-E1-H1
acccacagcgtccgcagggcagctctggtggctgatgagatagcggagcaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcagggttccgattgctaggctagctgcagctcaagtgcttgtctgaggctgcctcctcgttggcaaccgggattgcctgctgctggt

SEQ ID NO: 6786 - DNA, 462 bp, Zea mays
  Clone ID: LIB83-003-Q1-E1-D3
ggatgcggtactgttagccagctgcacggccgtcgagactccaggggccacacgcccgtccgcacacgcgactggaactttgggtacagcagggatgatgtggggaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctaggtgaacatta

SEQ ID NO: 6787 - DNA, 335 bp, Zea mays
  Clone ID: LIB189-002-Q1-E1-C11
agctctggtggctgatgagatagcggagcaggctgaattcttctccttcggaacgaacgacctgacgcagatgacctttgggtacagcagggatgatgtgggaaagttcattcccgtctatcttgctcagggcatcctccaacatgaccccttcgaggtcctggaccagaggggagtgggcgagctggtgaagtttgctacagagaggggccgcaaagctaggcctaacttgaaggtgggcatttgtggagaacacggtggagagccttcgtctgtggccttcttcgcgaaggctgggctggattacgtttcttgctcccctttcaaggttccga

SEQ ID NO: 6788 - DNA, 337 bp, Zea mays
  Clone ID: LIB36-002-Q1-E1-F3
caatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaacttgaaggtgggcatttgtggagaacacggtggagagccttcctctgtggccttcttcgcgaaggctgggctggattatgtttcttg

SEQ ID NO: 6789 - DNA, 411 bp, Zea mays
  unsure (1)...(411): unsure at all n locations
  Clone ID: LIB189-015-Q1-E1-F3
cgggggaacgtcatctgcagcacggtctagatatccgggtcgaccagcgtcagccgcaacagccaacttaagtgggcatttgtgaaaacgtgaaaccttctctgtggcctcttcgcgaaagctgggctggattacttntcttgctcccctttcagggttcgattgctaggctanctgcagctcaagtgcttgtctgaggctgcctcctcattggcaaccggattgcctgctgctggtggatgtggtgatcaacagtattattacagagccatgctatgtgaacattactagtagcagtgctcataaaagctacaatcccatgtccttttttttccccagtcatgtaaaacttccaaactgctccatggttcaaaactctgttcttcaatacatcatcaattatcgattaaa

SEQ ID NO: 6790 - DNA, 345 bp, Zea mays
  Clone ID: LIB189-013-Q1-E1-F6
atgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgatt

SEQ ID NO: 6791 - DNA, 422 bp, Zea mays
  unsure (1)...(422): unsure at all n locations
  Clone ID: LIB3061-007-Q1-K1-A1
gatgattatggctcccacagttgagcctaggtagcaggcgctggatcgccttctgccgtaccagaggtctgacttcgaaggcatcttccgtgctatggatggactttcagtgactattcgacttctggaccctcccctccacgagttccttccagaagggaacgtcgaggaaatcgtgcgtgaactgtgttctgagacgggagccaaccaggaggatgccctcgcacggatcgaaaagctttcggaagtaaacccgatgcttggcttccgtggctgcaggcttggtatatcgtaccctgagctaacagaaatgcaaggccgtgccatctttgaagctgctataacgatgaccaaccagggcgttcaagtctttccagagataatggttcctcttgttggaacaccgcangaattgggacatc

SEQ ID NO: 6792 - DNA, 396 bp, Zea mays
  Clone ID: LIB3060-054-Q1-K1-D4
ttcagtctgagaacccgtcggcgtacattgatcaagtgattgccactggtctgccagcctgacctgtggctgctgtgggccaggttgtgttcactgctgaggatgctgaaccatggcattcccaagggaaagctgctattctggtaagggcggataccagccctgatgacgtaggtggcatgcacgctgctgtggagattcttacagagaggcgtgagcatgacttaccacgctgctgcggtcgcacgtggctggtggaaatgctgcgtctagacatgctcaggcattcgcgtaaacgatgcggagaagctcgtgacgatcggaggccatgtgctgcgcgaatgtgagtggctgtcactgaatgaatagactggtgaggtgatccctgtgaagcat

SEQ ID NO: 6793 - DNA, 409 bp, Zea mays
  Clone ID: LIB3078-028-Q1-K1-A6
cccacgcgttcgcggacgcgtgggtgacgatcggaggccatgtgctgcgcgaaggtgagtggctgtcgctgaatgggtcgactggtgaggtgatccttgggaagcatccgctttccccaccagcccttattggcgatctgggaactttcatggcctgtgtggatgatgttagaaagctcaaggtcctggctaacgccgatacccctgatgatgcattgactgcgcgaaacaatggtgcacaaggaattggattatgccggacagagcacatgttctttgcttcagacgagagtgataacgctgtcaggcagatgattatggctcccacgctagagctgaggcagcaggcgctcgaccgtctcttgccgtatcagaggtctgacttcgaggcatgttccgtgctatggat

SEQ ID NO: 6794 - DNA, 417 bp, Zea mays
  Clone ID: LIB3059-047-Q1-K1-H7
agaggtctgacttcgaaggcattttccgcgctatggatggactttcagtgactattcgacttctggaccctccccttcacgagttccttccagaagggaacgtcgaggaaatcgtgcgtgaactgcgttctgagacgggagccaaccaggaggatgccctcgcacggatcgaaaagctttcggaagtaaacccgatgcttggcttccgtggctgcaggcttggtatatcgtaccctgagctaacagaaatgcaagcccgtgccatctttgaagctgctatagcgatgaccaaccagggcgttcaagtctttccagagataatgggtcctcttgttggaacaccgcaggaattgggacatcaggtggcccttatccgtcaagtcgctaacaagagcttcaccagtatggggaaaacta

SEQ ID NO: 6795 - DNA, 353 bp, Zea mays
  Clone ID: LIB36-021-Q1-E1-F1
cggacacgtgggctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgattgagatccccagggcaacctctggtggc

SEQ ID NO: 6796 - DNA, 450 bp, Zea mays
  unsure (1)...(450): unsure at all n locations
  Clone ID: LIB3059-002-Q1-K2-A4
agttagagtagttgatacagagaaagtgtagttcgacgctcggaattcggtcgaccagcgtcggaggcacagcgctggatcgcttttggcttacagaggttgacttcgaaggatttgccctgctatggatggactttcaatgactattcgacttctggacccttcccttcacgagttccttccagaagggaacgtcgaggaaatcgtgcgtgaactgtgttctgagacgggagccaaccaggaggatgccctcgcacggatcgaaaagctttcggaagtaaacccgatgcttggcttccgtggctgcaagcttggtatatcgtaccctgagctaacagaaatgcaagcccgtgccatctttgaagctgctatagcgatgaccaaccaaggcgttcaagtctttccagagataatggttcctcttgttggaacaccgcangaattgggaca

SEQ ID NO: 6797 - DNA, 312 bp, Zea mays
  Clone ID: LIB189-015-Q1-E1-G8
gccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtgggaaagttcattcccgtctatcttgctcagggcattctccaacatgaccccttcgaggtcctggaccagaggggagtgggcgagctggtgaagcttgctacagagaggggccgcaaagctaggcctaact

SEQ ID NO: 6798 - DNA, 328 bp, Zea mays
  Clone ID: LIB189-007-Q1-E1-F9
agtgaaaggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgatt

SEQ ID NO: 6799 - DNA, 444 bp, Zea mays
  Clone ID: LIB3079-013-Q1-K1-G8
cgaacgacctcacgcagatgacctttggctacagcagggatgatgtggggaagttgagccccatttatctggctcagggcatcctccagcatgaccccttcgaggttctcgaccagagaggagtgggcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcgctaggctagctgcagctcaggtgcttgtctgaggggctgcctcctcgttggcagcctgctgttggtgcatctggtgattaataatactactatgacagagccatatgctctgtgaagagtattaatagcagcgctcataaaagctacagttccatctat

SEQ ID NO: 6800 - DNA, 394 bp, Zea mays
  unsure (1)...(394): unsure at all n locations
  Clone ID: LIB36-015-Q1-E1-D2
ggggnccgctgtactgatactattgacgtccactgacggaacacatgggtcgacacaagcgtctacagtgattctcacaagtgggtgggggaaatgctgcgtctcgggatgctcaggcattcgcgtaaacgatgcggagaagctcgtgacgatcggaggccatgtgctgcgcgaaggtgagtggctgtcgctgaatgggtcgactggtgaggtgatccttgggaagcagccgctttccccaccagcccttagtggtgatctgggaactttcatggcctgagtggatgatgttagaaagctcacggtcctggcaaacgccgatacccctgatgatgcaatgactgcgcgaaacaatcgggcacaatgaattggagtacgcccgacagagcacatg

SEQ ID NO: 6801 - DNA, 339 bp, Zea mays
  unsure (1)...(339): unsure at all n locations
  Clone ID: LIB3059-018-Q1-K1-H2
cggacgcgtgggtgagattcccagggcagctctagtggctgacgagatcgcggagcagtctgaattcttctcctttggaacgaacgacctcacgcagatgacctttggctacagcagggatgatgtggggaagttcatccccatttatctggctcagggcatcctccagcatgaccccttcgaggttctcgaccagagaggagtgggcgagctggttaagcttgctacagagaggggccgcanagctaggcctaacttgaaggtgggcatttgtggagaacatggtggagagccttcatcggttgctttcttcgccaagactgggcttgattacgtttc

SEQ ID NO: 6802 - DNA, 303 bp, Zea mays
  unsure (1)...(303): unsure at all n locations
  Clone ID: LIB3078-007-Q1-K1-E1
aaaagctttcagaagtaaacccgatgcttgtcttccgtgggtgcaggcttggtatatcgtgccctgaattgacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttggaacaatgatngagatccccagggcaagctctgtggctgatg

SEQ ID NO: 6803 - DNA, 293 bp, Zea mays
  Clone ID: LIB3060-038-Q1-K1-H3
gggctgaagaacgacaccgacctcacggcctctgacctcaaagagctcgtgggtcagtagaaggaggtctacctctcagccaagggagagccattcccctcagaccccaagaagcagctggagctagcagtgctggctgtgttcaactcgtgggagagccccagggccaagaagtacaggagcatcaaccagatcactggcctcaggggcaccgccgtgaacgtgcagtgcatggtgttcggcaacatggggaacacttctggcaccggcgtgctcttcaccaggaaccccaa

SEQ ID NO: 6804 - DNA, 344 bp, Zea mays
  unsure (1)...(344): unsure at all n locations
  Clone ID: LIB36-020-Q1-E1-A9
agatgatgtcataaagctcaaggtcctggctaacgccgatacccctgatgatgcattgactgcgcgaaacaatggggcacaaggaattggattatgccggacagagcacatgttctttgcttcagacgagaggattaaggctgtcaggcagatgattatggctcccacgcttgagctgaggcagcaggcgctcgaccgtctcttgccgtatcagaggtctgacttcgaaggcattttccgtgctatggatggactcccggtgaccatccgactcctggaccctcncctccacgagttccttccagaagggaacatcgaggacattgtaagtgaattatgtgctg

SEQ ID NO: 6805 - DNA, 431 bp, Zea mays
  Clone ID: LIB3061-026-Q1-K1-D7
ctggcagtgactattcgacttctggaccctcccctccacgagttccttccagaagggggcgtcgaggaaatcgtgcgtgaactgtgttctgagacgggagccaaccaggaggatgccctcgcacggatcgaaaagctttcggaagtaaacccgatgcttggcttccgtggctgcaggcttggtatatcgtaccctgagctaacagaaatgcaagcccgtgccatctttgaagctgctatagcgatgaccaaccagggcgttcaagtctttccagagataatggttcctcttgttggaacaccgcaggaattgggacatcaggtggcccttatccgtcaagtcgctaacaaagttttcaccagtatggggaaaactattgggtacaagatcggaacgatgattgagattcccagggcagctctagtggctga

SEQ ID NO: 6806 - DNA, 367 bp, Zea mays
  Clone ID: LIB36-021-Q1-E1-G7
cccacgcgtccgcggacgcgtgggcgcgcgtgggcggacgcgtgggcagaggtctgacttcgaaggcattttccgtgctatggatggactcccggtgaccatccgactcctggaccctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaggcttggtatatcgtaccctgaattgacagagatgcaagcccgggccatttttgaagctgctatagcaattgacaaccagggtgttcaagtgttcccagagata

SEQ ID NO: 6807 - DNA, 432 bp, Zea mays
  unsure (1)...(432): unsure at all n locations
  Clone ID: LIB3059-028-Q1-K1-G7
cggacgcgtgggcagggatgatgtggggaagttcatccccatttatctggctcaggggatcctccagcatgaccccttcgaggttctcgaccagagaggagtgggcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcgctaggctagctgcagctcaggtgcttgtctgagggtgcctctgctcgttggcagccggatcgcctgctgttggtgcatctggtgattaataatactactatgacagagccatgctctgtgaagagtattagtagcagcgctcataaaagctacagntccgtctcttttc

SEQ ID NO: 6808 - DNA, 439 bp, Zea mays
  unsure (1)...(439): unsure at all n locations
  Clone ID: LIB189-029-Q1-E1-D4
tgctctacacttcacctgtcggtccggtccacattaccggtcgagncacgcgtccaaggacacttgggtgaccccttcaaggtcctggacaaaagggaattgggcaacctggtgaattttgctacaaaaaggggccgcaaagctaggcctaacttgaaggtgggcatttgtggaaaaaacggtggaaagccttcgtctgtggccttcttcgcaaaggctgggctggattacgtttcttgctcccctttcagggttccaattgctaggctacctgcacctcaagtgcttgtctgaggctgcctcctccgttggaaaccggattgcctgctgctggtggatgtggtgatcaacagtattattacacagccatgctaagtgaacattactagtagcagtgctcataaaagctacaatcccatctcccttttttttccaatca

SEQ ID NO: 6809 - DNA, 324 bp, Zea mays
  Clone ID: LIB3060-020-Q1-K1-F2
gtctcttgccgtatcagaggtctgacttcgtaggcattttccgtgctatggatggactcccggggaccatccgactcctggaccctcccctccacgagttccttccagaagggaacatcgaggacattgtaagtgaattatgtgctgagacgggagccaaccaggacgatgccctcgcgcgaattgaaaagctttcagaagtaaacccgatgcttggcttccgtgggtgcaggcttggtatatcgtaccctgaattgacagagatgctaggcccggccattgttgaagctgctatagcaatgaccaaccagggtgttcaagtgt

SEQ ID NO: 6810 - DNA, 338 bp, Zea mays
  Clone ID: LIB36-007-Q1-E1-E9
gttactgagaaagtgttcgccaatgtgggcaagactatcgggtacaaagttggaacaatgattgagatccccagggcagctctggtggctgatgagatagcggagcaggctgaattcttcgccttcggaacgaacgacctgacgcagatgacctttgggtacagcagggatgatgtggggaagttcattcccgtctatcttgctcagggcatcctccaacatgaccccttcgaggtcctggaccagaggggagtgggcgagctggtgaagtttgctacagagaggggccgcacagctaggcctaacctgaacgtgggcatttgtggagaacacggtgg

SEQ ID NO: 6811 - DNA, 416 bp, Zea mays
  Clone ID: LIB3059-017-Q1-K1-C3
aacgacctcacgcagatgacctttggctacagcagggatgatgtggggaagttcatccggatgtatctggctcagggcatcctccagcatgaccccttcgaggttctcgaccagagaggagtgggcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcgctaggctagctgcagctcaggtgcttgtctgagggtgcctctgctcgttggcagccggatcgcctgctgttggtgcatctggtgattaataatactactatgacagagccatgctctgtgaagagtattagta

SEQ ID NO: 6812 - DNA, 370 bp, Zea mays
  Clone ID: LIB3061-051-Q1-K1-H5
cccacgcgtccggctagctgcagctcatgtgcttgtctgagggtgcctctgctcgttggcagccggatcgcctgctgttggtgcatctggtgattaataatactactatgacagagccatgctctgtgaagagtattagtagcagcgctcataaaagctacagttccgtctcttttctcagctatgtaaaacttccaaactgttcatgcttaaaactgagggttttcttggtgtgaggtgtgcatgtcgttgttgaggccattgctgcacattccacctattgaggccctcctcaaattaagcctcgaaaaagctgatatcttttcgtaaaactctagactacggtgaatgcaactgggctggttgcttc

SEQ ID NO: 6813 - DNA, 319 bp, Zea mays
  Clone ID: LIB3061-009-Q1-K1-F12
cagacgcggatacccctgaggatgcattggctgcgcggaacaacggggcagaaggaatgcgggttgtgccggacagagcacatgttcttcgcttcggatgagaggattaaggctgtgaggcagatgattatggctcccacagttgagctgaggcagcaagcgctggatcgccttctgccttaccagaggtctgacttcgaaggcatcttccgtgctatggatggactttcagtgactattcgacttctggaccctccactacacgagttcctttcagaagggaacgtcgaggaaatcgtgcgtgaactgtgttctgaga

SEQ ID NO: 6814 - DNA, 329 bp, Zea mays
  Clone ID: LIB3061-041-Q1-K1-C5
ggtggcccttatccgtcaagtcgctaacaaagttttcaccagtatgggtaaaactatggggtacaagatcgggacgatgattgagattcccagggcagctctagtggctgacgagatcgcggagcaggctgaattcttctcctttggaacgaacgacctcacgcagatgacctttggctacagcagggatgatgtggggaagttcatccccatttatctggctcagggcatcctccagcatgaccccttcgaggttctcgaccagagaggagtgggcgagctggttaagcttgctacagagaggggccgcaaagctaggcctaacttga

SEQ ID NO: 6815 - DNA, 288 bp, Zea mays
  Clone ID: LIB36-013-Q1-E1-B6
cccacgcgtccgggaactggggcatcaagtgactcttatccgccaagttgctgagaaagtgttcgccaatgtgggcaagactatcgggtacaaagttggaacaatgattgagatccccagggcagctctggtggctgatgagatagcggagcaggctgaattcttctccttcggaacgaacgacctgacgcagatgacctttgggtacagcagggatgatgtggggaagttcattcccgtctatcttgctcagggcatcctccaacatgaccccttcaaggtcctgaa

SEQ ID NO: 6816 - DNA, 272 bp, Zea mays
  Clone ID: LIB84-016-Q1-E1-A7
tttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgatt

SEQ ID NO: 6817 - DNA, 384 bp, Zea mays
  Clone ID: LIB84-002-Q1-E1-D6
catgaactggggcatcaagtgactcttatccgacaagttgctgagaaagtgttcgccaatgtgggcaagactatccggtacaaagttggaacactgattgagatccccagggcagctctggtggctgatgagatagcggagcaggctgaattcttctccttcggaacgaacgacctgacacagatgacctttgggtacagcagggatgatgtgggaaagttcattcccgtctatcttgctcagggcattctccaacatgaccccttcgaggtcctggaccagtggggagtgcgcgagctggtgaagcttgcgacagagaggggccgctcaactacggctaacttgtaggtgcgcatttgtggaaaagacggtggagagccgtcc

SEQ ID NO: 6818 - DNA, 302 bp, Zea mays
  Clone ID: LIB3060-039-Q1-K1-E5
ttcttcctagcccggtccatttttgaagctgctatatcaatgaccaaccagggtgttcaagggtgcccatatataatggttcctcttgttggaacaccacaggaactggggcatcaagtgactcttatccgccaagttgctgagaaagtgttcgccaatgtgggcaagactatcgggtacaaagttggaacaatgattgagatccccagggcagctctggtggctgatgagatagcttatcatgctgaattcttcttcttctgaacgaacgacctgactcagatgacctttgggttcatcag

SEQ ID NO: 6819 - DNA, 394 bp, Zea mays
  Clone ID: LIB3078-011-Q1-K1-E7
gcgcccacgcgtccgatacccctgatgatgctttgactgcgcgaaacaatggggcacaaggagtcggattatgccggacagagcacatgttctttgcttcagacgagaggattaaggctgtcacgcagatgattatggctgccacgcttgagctgacgcagcaagcgctcgaccgtgtcttgccgcatcataggtctgacttcgaacgcattttccgtgctacagatggactcccggtgaccatgcgactgctggaccctgcgctgcaccagttccttccagaagggaacatcgcggacattgcacgtgaatcatgtgctgagacggcagccaaccaggacgatgccctcgcgcgaattgaacagctctcagaagcaaacccgacgcttggctt

SEQ ID NO: 6820 - DNA, 300 bp, Zea mays
  Clone ID: LIB3060-052-Q1-K1-H8
atctgaggccatgtgctgcgctaaggtgagtggctgtcactcgaatgggttgactggtgaggtgatccttgggaagcaggcgttttccccaccgatcattagtggtgatctgggaactttcatggcctgcatggatgatgttcgaatgctcaaggtcctggctaacgccgataccacgtgatgatgcattgactcgtcgaaacactggggcacaaggaattggattatgccggacagagcacatgttcaccgcttcatacgagaggatttaggctgctaggcctatgattatggctccca

SEQ ID NO: 6821 - DNA, 346 bp, Zea mays
  Clone ID: LIB3060-026-Q1-K1-D7
ggttggcggaataagaaccccaaagtacctttacgccatgaagaacctcatgccacaggcctgggacgagcttgttgagaactgcaacatcctgcagagccactacaaggaaatgcatgatatcgagttcactgtccaggaaaacaagctgtggatgttgcagtgcacgacagggaaacgtactggcaaaaatgccgcgaagatcgccgtggacatggttaacgagtgccttgtagagccccgctcagcgatcaagatgctagagccaggccacctcgaccagcttctccatgctcagattgagaacccttcagcgtacaaggttcaagtcattgccactggactg

SEQ ID NO: 6822 - DNA, 397 bp, Zea mays
  Clone ID: LIB3059-003-Q1-K1-F1
cgaccagagaggagtgggcgagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcgctaggctagctgcagctcaggtgcttgtctgagggtgcctctgctcgttggcagccggatcgcctgctgttggtgcatctggtgattaataatactactatgacagagccatgctctgtgaagagtattagtagcagcgctcataaaagctacaggtccgtctcttttctcagctatgtaaaacttccaaactgttcatgcttaaaactgagggttttctt

SEQ ID NO: 6823 - DNA, 406 bp, Zea mays
  Clone ID: LIB189-006-Q1-E1-C4
ggttacggcaacgtcagctgtcagtaggctctaaattctaagtcgaccgacccgtccacccacgcgtccgggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgattata

SEQ ID NO: 6824 - DNA, 272 bp, Zea mays
  unsure (1)...(272): unsure at all n locations
  Clone ID: LIB189-029-Q1-E1-C2
ggctcctncaacgtattctgcagccacgggcaagcatcccgggccgacccangcttcgacggaaccttggggacagagatgcaagcccgggccatttttgaagctgctatagcaatgaccaaccagggtgttcaagtgttcccagagataatggttcctcttgttggaacaccacaggaactggggcatcaagtgactcttatccgccaagttgctgagaaagtgttcgccaatgtgggcaagactatcgggtacaaagttgggacaatgat

SEQ ID NO: 6825 - DNA, 232 bp, Zea mays
  Clone ID: LIB84-003-Q1-E1-C2
aatcaggtgcttgtctgaggctgcctcctcattggcaaccggattgcctgctgctggtggaagtggtgatcaacagtattattacagagccatgctatgtgaacattactagtagcagtgctcataaaagctacaatcccatgtcctttttttccccagtcatgtaaaacttccaaactgctccatggttcaaaactctgttcttcaatacatcatcaattatcgattatat

SEQ ID NO: 6826 - DNA, 262 bp, Zea mays
  Clone ID: LIB36-014-Q1-E1-A2
cccacgcgtccgctcccctccacgagttccttccagaagggaacatcgaggacattgtaagtgaattatgtgctgagacgggagccaaccaggaggatgccctcgcgcgaattgaaaagctttcagaagtaaacccgatgcttggcttccgtgggtgcaagcttggtatatcgtaccctgaattgacagagatgcaagcccgggccatttttgaagctgctataacaatgaccaaccacggtgttcaagtgttcccagagat

SEQ ID NO: 6827 - DNA, 354 bp, Zea mays
  Clone ID: LIB3078-011-Q1-K1-D6
cccacgcgtccgcccacgcgtccgggtttttgtggagaacacggtggagagccttcgtgtgtggccttcttcgcgaaggctgggctggattacgtttcttgctcccctttcagggttccgattgctaggctagctgcagctcaggtgcttgtctgaggctgcctcctcgttggcaaccggattgcctgctgctggtggatgtggtgatcaacagtattattacagagccatgctatgtgaacattactagtagcagtgctcataaaagctacaatcccatctcccttttttttccagtcatgtaaaacttccaaactgctccatggttcaaaactctgttcttcaatacaaaaa

SEQ ID NO: 6828 - DNA, 247 bp, Zea mays
  Clone ID: LIB3059-031-Q1-K1-E3
gcgctggtgattaataatactactattacttagccatgctctgtgaagagtattaggaccgtcgctcataaaagctacagttccgtctcttttctcagctatgtaaaacttccaaactgttcatgcttaaaactgagggttttcttggtgtgaggtgtgcatgtcgttgttgaggccattgctgcacattccacctattgaggccctcctcaaattaagcctcgaaaaagctgatatcttttcgtag

SEQ ID NO: 6829 - DNA, 380 bp, Zea mays
  Clone ID: LIB189-023-Q1-E1-E7
aggagctggttaagcttgctacagagaggggccgcaaagctaggcctaacttgaaggtgggcatttgtggagaacatggtggagagccttcatcggttgctttcttcgccaagactgggctggattacgtttcttgctcccctttcagggtcccgatcgctaggctagctgcagctcaggtgcttgtctgaggggctgcctcctcgttggcagcctgctgttggtgcatctggtgattaataatactactatgacagagccatatgctctgtgaagagtattagtagcagcgctcataaaagctacagttccatctattttctcagctatgtaaaacttccaaactgttcatgcttaaaactgagggttttcgtggtgtg

SEQ ID NO: 6830 - DNA, 437 bp, Zea mays
  unsure (1)...(437): unsure at all n locations
  Clone ID: LIB83-009-Q1-E1-D12
caggcattcgcgtaaacgatgcggagaagctcgtgacgatcggaggccatgtgctgcgcnaangtgagtggctgtcnctgaatgggtcgactggtgaggtgatncttgnaaagcanccgctttccccancagcccttantggcgatctgggaactttcaaggcctgngtggatnatgttagaaagctcaaggtcctggctaacgccnatncccctgatgatgcntttgaccggcgcggaaaacaaattgggcacaacggaattgggatttctnccttgaccagaaacacatggttctnttgcctcagancgancancgattnaaggctnttcanggcnnaataaattatnngctccccnngctttgaaccntaaaggcancacggggctcnganngttngntttgccgtttncnaaaggtttnncnttccaaacntt

SEQ ID NO: 6831 - DNA, 183 bp, Zea mays
  Clone ID: LIB83-010-Q1-E1-G9
cctgctgctggtggatgtggtgatcaacagtattattacagagccatgctatgtgaacattactagtagcagtgctcataaaagctacaatcccatgtccttttttttccccagtcatgtaaaacttccaaactgctccatggttcaaaactctgttcttcaatacatcatcaattatcgatt

SEQ ID NO: 6832 - DNA, 417 bp, Zea mays
  unsure (1)...(417): unsure at all n locations
  Clone ID: LIB189-017-Q1-E1-A5
gggttntgcaacttacctgcatggtcggctcagatctagaagtcccaggccgacgtacgcatgtacgcaagcgtccgggaccacaggggactgagcgagctggtgaactctgccaaaaaaaaggtgcccaaaactaagcccaaattaaaggttggcaattgtgaaaacacggtgaaaccctcctcgtggcctcttcgcgaacgctgggctcgattacgtttcatgctcccctttcaaggttccgattgctaagctagctgcagctcaggtgcttgtctgaggctgcctcctccttggcaaccggattgcctgctgctgatggatgtggtgatcaacagtattattacaaagccatgctatgtgaacattactagtagcagtgctcataaaagctacaatcccatctccctttttttt

SEQ ID NO: 6833 - DNA, 362 bp, Zea mays
  Clone ID: LIB3061-002-Q1-K1-D12
gctaggcctaacttgaaggtgggctaaagtggacaacatggtggagagccttgagcggttgttatattcgccaagactgggctggattacgtttcttgctcccctttcagggtcccgatcgctaggctagctgcagctcaggtgcttgtctgagggtgcctctgctcgttggcagccggatcgcctgctgttggtgcatctggtgattaataatactactatgacagagccatgctctgtgaagagtattagtagcagcgctcataaaagctacagttccgtctctattctcagctatgtaaaacttccaaactgttcatgcttaaaactgaaggttttcttggtgtgaggtgtgcatgtcg

SEQ ID NO: 6834 - DNA, 345 bp, Zea mays
  unsure (1)...(345): unsure at all n locations
  Clone ID: LIB3059-058-Q1-K1-A4
ctaggcctaacttgaaggtgggcatttgtggagaacatggtggagagccttcatcggtggctttcttcgccaagactgggctggattacgtttcttgctcccctttcagggtcccgatcgctaggctagctgcagctcaggtgcttgtctgagggtgcctctgctcgttggcagccggatcgcctgctgttggtgcatctggtgattaataatactactatgacagagccatgctctgtgaagagtattagtagcagcgctcataaaagctacagttccgtctcttttctcagctatgtaaaacttccaaactgttcatgcctaaaactganggttttctggtgt

SEQ ID NO: 6835 - DNA, 506 bp, Zea mays
  unsure (1)...(506): unsure at all n locations
  Clone ID: LIB3059-023-Q1-K1-C3
ngaggtaggaagagcgctgtngttttatagcagggaggaaggcgaggtattgcttagcgtactcggtntccggnnaatatcccggggtcggacacncaaggccggttccggcgcacagccggttccggcgggacacccgttggggcgcacaggggcctgtcacaagtccttttctcaagaaatataatgggggtccttcttgtgtgggaaccaaccggaaggaatatggggaccattaaggtgggccctttaatccgtcaaaggtcgttaaccaaaaggttttcaccaagtatggggtaaaaactaattggggtacaaagaatcgggaccaatgattgagattcccagggcagctctagtggctgacgagatcgcggagcaggctgaattcttctcctttggaacgaacgacctcacgcagatgacctttggctacagcagggatgatgtggggaagttcatccccatttatctggctcagggcattcttcagcatgaccccttcg

SEQ ID NO: 6836 - DNA, 410 bp, Zea mays
  unsure (1)...(410): unsure at all n locations
  Clone ID: LIB189-027-Q1-E1-F4
gggctagagtaaacgtcaaccttcgcacgcccaggtcacganttaccggccgaccaagccttcagccaaacctccgcccaagcctccggtcctggctaaagccgaaacccccgaagaagcaattactgccccaaacaatggggcacaaaggaattgattaagcccgacaaaacacaagttccttgccttcaaacaaaaggataaaggcgttaagcaaattaataatggccccaagccttaacctaaggcacaggcgctcgaccgtctcttgccgtatcagaggtctgacttcgaaggcattttccgtgctatggatggactcccggtgaccatccgactcctggaccctcccctccacgagttccttccagaagggaacatcgaggacattgtaagtgaattatgtgctg

SEQ ID NO: 6837 - DNA, 257 bp, Zea mays
  Clone ID: LIB3059-020-Q1-K1-E10
tttcttgctcccctttcagggtcccgatcgctaggctagctgcagctcaggtgcttgtctgagggtgcctctgctcgttggcagccggatcgcctgctgttggtgcatctggtgattaataatactactatgacagagccatgctctgtgaagagtattagtagcagcgctcataaaagctacagttccgtctcttttctcagctatgtaaaacttccaaactgttcatgcttaaaactgagggttttcttggtgtg

SEQ ID NO: 6838 - DNA, 399 bp, Zea mays
  unsure (1)...(399): unsure at all n locations
  Clone ID: LIB3060-045-Q1-K1-H10
gcagctcaggtgcttgtctgaaccctgaaaggggagcaggaaacgtattccagcccggcctgggcgaagaaggccacagaggaaggctctccaccgtgttctccacaaatgcccaccttcaagttaggcctagctttgcggcccctttctgtagcaaacttaaccagctcgcccactcccctctgttcaggacctcgaaggggtcatgttgagatgccctgcgcgaattgaaaagcttcaaaggtaaacccgatgcttggcttacgtgggtgcangcttggtatatcgtaccctgaattgacaganatgcaagccctggccatttttgaagctgctatagcaatgaccaaccagggtgttcaagtgttcccagagataatggctcctcttgttggaaca

SEQ ID NO: 6839 - DNA, 395 bp, Zea mays
  Clone ID: LIB84-003-Q1-E1-A10
aacaaagctaggcctaacttgaaggtgggcatttgtggagaacacggtggagagccttcctctgtggccttcttcgcgaaggctgggctggattacgtttcttgctcccctttcagggttccgattgctaggctagctgcagctcaggtgcttgtctgaggctgcctcctcattggcaaccggattgcctgctgctggtggatgtggtgatcaacagtattattacagagccatgctatgtgaacattactagtagcagtgctcataaaagctacaatcccatgtcctttttttccccagtcaagttaaacttccaaaacggctccatggggtcaaaagctctgttcttcaatacatcaagcaattatcgaataatatacgttgcaaaatttttt

SEQ ID NO: 6840 - DNA, 423 bp, Zea mays
  Clone ID: LIB3059-037-Q1-K1-H8
ggcacgcctccgggacaacttgggtttagccctcaacgggttgcttccttccccaggacgtggggctgaattccgtttcttgctccccttttcagggccccgatcgctaggctagctgcaactcaagtgcttgtctgacggtgcctctgctcgttggcagccggatcgcctgctgttggtgcatctggtgattaataatactactatgacagagccatgctctgtgaagagtattagtagcagcgctcataaaagctacagttccgtctcttttctcagctatgtaaaacttccaaactgttcatgcttaaaactgagggttttcttggtgtgaggtgtgcatgtcgttgttgaggccattgctgcacattccacctattgaggccctcctcaaaataagccttcaaaaagctgatatctttt

SEQ ID NO: 6841 - DNA, 418 bp, Zea mays
  Clone ID: LIB3060-051-Q1-K1-C1
cctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacg

SEQ ID NO: 6842 - DNA, 411 bp, Zea mays
  unsure (1)...(411): unsure at all n locations
  Clone ID: LIB3060-015-Q1-K1-G11
ccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaagccgccggcgtcatccgctccgactccggcgcgggacggngccagcattgctcgccgctgagggccgtcgttgacgccgcgccgatacagacg

SEQ ID NO: 6843 - DNA, 451 bp, Zea mays
  Clone ID: LIB3060-017-Q1-K1-A8
ctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaataagagggtgttccacttcgggcagggca

SEQ ID NO: 6844 - DNA, 412 bp, Zea mays
  unsure (1)...(412): unsure at all n locations
  Clone ID: LIB3060-014-Q1-K1-C3
acgctgaccttttcgctgtactcactcgccacacacaccccctctccagctccgttggagcgtccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctganggccgtcgttgacgccgcgccgat

SEQ ID NO: 6845 - DNA, 427 bp, Zea mays
  unsure (1)...(427): unsure at all n locations
  Clone ID: LIB3060-010-Q1-K1-H5
gctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcggtttccagggccatctgcgttcagaagccgggctcaaaatgcaccagggacagggaagcgacctccttcgcccgccgatcggtcgcagcgccgaggcccccgcacgccaaagccgccggcgtcatccgctccgactccggcgcgggacggngccagcattgctcgccgctgagggccgtcgttgacgccgcgccgatacagacgaccaaaaagagggtgttccactt

SEQ ID NO: 6846 - DNA, 380 bp, Zea mays
  Clone ID: LIB3060-045-Q1-K1-C7
gcggcggcggtttccagggccatctgcgtccagaaaccgggctccaaatgcagcagggacagggaagcgacctccttcgcccgccgaacggtcgcggcgccgaggcccccgcgcgccaaagccgccggcgtcatccgctccgactccggcgcgggacggggccagcagtgctcgccgctgagggccgtcgttgacgccgcgtcgatacagacgaccaaaaagagcaaatggcgcctcagtctcccgcgcgcaagctacaacggttcaaggtccggtgctgcggcggctgagccgtctaccgtgggagacaccttggaacgggaggagggcggcggcacagaggcaggcgcttcggctgatgagtcatccaaccggaagca

SEQ ID NO: 6847 - DNA, 419 bp, Zea mays
  unsure (1)...(419): unsure at all n locations
  Clone ID: LIB3060-027-Q1-K1-E7
ggcggcggcggtttccagggccatctgcgtccagaaaccgggctccaaatgcagcagggacagggaagcgacctccttcgcccgccgaacggtcgcggcgccgaggcccccgcgcgccaaagccgccggcgtcatccgctccgactccggcgcgggacggggccagcagtgctcgccgctgagggccgtcgttgacgccgcgtcgatacagacgaccaaaaagagcaaatggcgcctcagtctcccgcgcgcaagctacaacggttcagggtccggtgctgcggcggctgagccgtctaccgtgggagacaccttggaacgggaggagggcggcggcacagaggcaggcgcttcggctgatgagtcatccaaccggaagcagccgnccnctgttgaccccaagattgagaaggagctca

SEQ ID NO: 6848 - DNA, 286 bp, Glycine max
  Clone ID: 700646607H1
gtgaaaacaaagtttatggcgaatttctaatgaatgctcagggagaggatgtagttgctggaatcaggacacctgaagatttggaggttatgaaaacttgcatgccagaagcttataaggaacttgaggagaactgtgaaattctagagaaacattacaaggatatgatggatattgaattcactgtccaagaaaataggttgtggatgttgcaatgtcgaagcggaaaacgtaccggtaaaggtgcattcaaaatagctgtagatatggttgatgaggggcttgt

SEQ ID NO: 6849 - DNA, 266 bp, Glycine max
  Clone ID: 700787466H2
gatgatgttggcaaatttcttcctatatacctatccagtgggattctgcagcatgatccattcgaggtacttgaccaaaaaggtgtgggtcaactaatcaagatttgcacagagaagggtcgtgctgctagaccaaacttgaaggttggaatatgtggggagcatggtggggagccttcttcagttgcattctttgctgaaatcggacttgactatgtttcatgttctccttttagggttccaattgctaggcttgcagcagcaca

SEQ ID NO: 6850 - DNA, 377 bp, Glycine max
  Clone ID: LIB3054-008-Q1-N1-C5
tgggttcttctttaagctataaggttggaactatgattgaagttccaagggctgcactagttgcagatgagattgcaaaggaagcagaattcttttcgtttggaaccaatgaccttactcaaatgacatttggatatagtagagatgatgttggcaaatttcttcctatatacctatccagtgggattctgcagcatgatccattcgaggtacttgaccaaaaaggtgtgggtcaactaatcaagatttgcacagagaagggtcgtgctgctagaccaaacttgaaggttggaatatgtggggagcatggtggggagccttcttcagttgcattctttgctgaaatcggacttgactatgtttcatgttctcctttt

SEQ ID NO: 6851 - DNA, 157 bp, Zea mays
  Clone ID: 700043816H1
gcagccttggtttcgattgcactatttggtgcgtttgtaggccgggctgctatatcgactgttgatgctctggctcctaaattattcatcgggcttattgccggtgcatatgctcccgtactggttctcggcaatgaccatgaagactgttgacaat

SEQ ID NO: 6852 - DNA, 256 bp, Zea mays
  Clone ID: 700049210H1
tgtcgtgtcgcgcgtgaagctctccccggccgcgtccggcggcagcggcggcaaggccggctacgccgactccctcatcgaggaggaggaggggctcaacgaccacaacgtcgtcgtcaagtgcgccgagattcacaacgccatctccgaagaggaacatcggttcttttcaccgagtatcaatatgttgggatcttcatggcgatcttcgccggtgtgatcttcctcttccctgggtcgggtgagggagtcagca

SEQ ID NO: 6853 - DNA, 292 bp, Zea mays
  Clone ID: 700098741H1
ggagggactcaacgaccacaacgtcgtcgtcaagtgcgccgagatccagaccgccatctctgaaggagctacatctttccttttcactgagtacaagtatgttggattattcatgggcatctttgcaatccttatattcctcttccttgggtctgtcgagggattcagcacgaagagtcaaccttgccactatatcaaggaccagacttgcaagcctgcccttgctaatgccatcttcagtactatagcttttgtgcttggtgcagtcacctcactagtttccggctttctt

SEQ ID NO: 6854 - DNA, 168 bp, Zea mays
  Clone ID: 700100718H1
accacgcgtccgtggcttcctgcttgctgccagcggtcttttggttctttacattgctatcaatttgtttggaatttattacggtgatgactgggaaggtctttttgaagctattactggttatggccttggtggttcttctatggctcttttcggccgcgttggtgg

SEQ ID NO: 6855 - DNA, 305 bp, Zea mays
  unsure (1)...(305): unsure at all n locations
  Clone ID: 700105040H1
atacgnacacgcgtccgcggaccgtggcgactggntatattatgtttggcttggagtagattcacctgggtcaatgaaggttactgacttgcctcttctccttgatgggacatggatttggtgcctaaattgttgccctttttgctcagttgggtggtggaatatacaccaaagctgctgatgttggagctgatctggtcggaaaagttgagcagggaatacccgaagatgatcctcgtaacccagctgtcattgctgacttggttggtgacaatgttggagattgtgctgcccgaggcgctgat

SEQ ID NO: 6856 - DNA, 219 bp, Zea mays
  Clone ID: 700150777H1
caaggagatgatccccccaggtgctcttgttatgctgacaccactgatcgttgggatcttgacacaggttgcgtagtcaggctttgtggtgccctccatgagcccagggatggtgttgaactgccggcggacttcctccaccatcttgagtgcagcactgcctacacttttcattgtcattgccgagaaccagtatgggagcatagcaccaacaataag

SEQ ID NO: 6857 - DNA, 241 bp, Zea mays
  Clone ID: 700155610H1
atagctgacaacgctggcggtattgttgagatgtgccagcagcctgaaagtgtgagggaaatcacagatgttctagatgctgtgggcaacacaactaaagctactacgaaaggatttgccatagggtcagcagctctgagcttcctctcctcctgtttagtgcatatatggctgaagtatcttcttctgctcaattgccattcaaggaggttgatatagcagtcccagagatttttgatgg

SEQ ID NO: 6858 - DNA, 254 bp, Zea mays
  Clone ID: 700163331H1
gccgcgcacccctggcacgacctcgagatcggtcctgaagctccggccgtcttcaacgtcgtcgtggagatcaccaaggggagcaaggtgaagtacgagctggacaagaagacggggctcatcaaggtggaccggatcctctactcgtccgtcgtctaccctcacaactacggcttcgtgccccggacgctctgcgaggacaacgaccccatggacgtcctcgtgctcatgcaggaacccgtccttcccggcgc

SEQ ID NO: 6859 - DNA, 205 bp, Zea mays
  Clone ID: 700171438H1
tttgtttcctgctctggccaaattccagacaagaagaacgagaacaaggaggtggccgtcaacgacttcctgcccgccgccgctgcccgcgaagcatccagtactccatgtaaagtcgccctgctcatttatctcgtggatgacttgaaaaaaaacgaggtttggattctgggactctgcattcgtacgtgttgacatggatctt

SEQ ID NO: 6860 - DNA, 248 bp, Zea mays
  Clone ID: 700193866H1
ccgacgtcaccgaggtgaagggttccgacgaggttgggccggcgctcaagcggcagatcctcatctccaccgtgcttatgaccgccggcatcgccgccgtcaccttcctcggcctgccgcccagcttcaccctcttcgacttcggcaacgacaagcacgtcaagaactggcacctattcatctgcgtgtcggccggtctgtgggcggggctcgtgatcggctacgtcaccgagtacttcacgagcaac

SEQ ID NO: 6861 - DNA, 241 bp, Zea mays
  Clone ID: 700202576H1
tcgacatgtgtgaatatggagcgtgtctgacgatccttccggtgcgcgtccgtccgtccgttacgtacgtggtgccgacgagcaggtcgtggagatcaccaaggggagcaaggtgaagtacgagctggacaagaagacggggctcatcaaggtggaccggatcctctactcgtccgtcgtctaccctcacaactacggcttcgtgccccggacgctctgcgaggacaacgaccccatggac

SEQ ID NO: 6862 - DNA, 324 bp, Zea mays
  Clone ID: 700206487H1
ggttcctgccttgaacgaaaggatactgtcatccatgtccaggaggtctgttgctgcacacccttggcatgatctggagataggtcctggtgctccaaccatattcaactgcgtaaggccaccctgtcatgcttgactggtcctcttgtgatatgttcatgttaatagcatgatgtcttttgttctattggaaaataaaaagtctccctggactctaaaatcaatgcctgtgaacacatgaactgtttgtgtcacccatgttcctctgctccttggcactttctgatgcatgctcaaatgcttaagaaagactcatagaagcga

SEQ ID NO: 6863 - DNA, 313 bp, Zea mays
  unsure (1)...(313): unsure at all n locations
  Clone ID: 700216624H1
ctttggctcttatgctgagtcttcatgcgctgcacttgtcgttgcctcaatctcttcatttgggatcaatcatgaattcacccctatgttgtacccactcctcattagctctgtgggtatcatagcttgcttgataaccactctttttgcaactgatttctttgagatcaaggctgtagatgaaattgagccggctctcaagaagcagcttataatttccactgctgtgatgactgttggcatgcacttgtcagttggttagggcttccatatacatncacaatcttcaattnggtgtacnagagganggtgt

SEQ ID NO: 6864 - DNA, 123 bp, Zea mays
  Clone ID: 700217292H1
ctccgcgccagggccatcggcctcatgcctatgatagatcagggagagaaggacgacaagatcatcgccgtctgcgccgacgaccccgagtaccgccactacaacgacatcagcgagctctcc

SEQ ID NO: 6865 - DNA, 286 bp, Zea mays
  Clone ID: 700240889H1
ggccgctccgccaccccgcactcgcctgtcgcctcttctcgctttcgccaccggggcagcgctccggtgagtggcgaagggcccctcccggctcccgcttccctctgccatggctggacctgctgttctcaatgagcgtatcctttcttccatgtcccagaaacatgttgctgctcaaccatagcatgatttggagataggaccaggggctcctgaattcttcaattgtgtggttgagattcctagaggcagcaaggttaagtacgagttggacaaggcatctggt

SEQ ID NO: 6866 - DNA, 251 bp, Zea mays
  Clone ID: 700242309H1
aggttgatgttctgacacccaaagttttcattggactgattgttggtgcgatgctcccatactggttctcagcgatgacaatgaagagtgttggaagtgcagcaataaagaccgttgcgcgccacggcacggcagtaaaagaaaatacgcggggtcatggagggccttaggaagcgtgagtatgcgaagtgtgttaagatgtctactgatgcatctattaaggagatgataccacctggtgcacttgtgat

SEQ ID NO: 6867 - DNA, 289 bp, Zea mays
  unsure (1)...(289): unsure at all n locations
  Clone ID: 700347658H1
cttgcagggagagaaggacgacaagatcatcgccgtctgcgccgacgaccccgagtaccgccactacaacgacatcagcgagctctcccctcaccgcctccaggagatccgccgcttctttgaagactgtacgcgcgcttgctctctctctctctctctgggggcgcgctttctggngnctctctctctctctctatctctcggcgctcgctgtgtgcgcgcgcggtgctctgtgagcgcgcgcgcccctctgtatgagtgcgtgtgtgggtgttgtgtctcgcgctct

SEQ ID NO: 6868 - DNA, 285 bp, Zea mays
  Clone ID: 700349391H1
gctgtagcaacaatggggatgcttagcactgcagggtatgttctcaccatggacatgtttggtcctatagctgacaacgctggtggtattgttgagatgagccagcagcctgaaagtgtgagggaaatcacagatgttctagatgctgtgggcaacacaactagagtctattacgaaagttttcccaatgggtcaacacatttgggtttcctcctcctgtttagtgcatataaggaagaagtagcttcttttgctcaattgccattcaaggaggttgatctagca

SEQ ID NO: 6869 - DNA, 277 bp, Zea mays
  Clone ID: 700427206H1
caaatttccaatgacttgccatatcattagcatcagaggctccataaagcagctctgctagaattaactgattcactgtcaaggtcaaacatcactatgatattgctgagatggtccaatcagtgacaatgctggtggtattgttgagatggcaggcatgagccacaaaatctgagagaacttatgctcttggtgctgctgacaacacaactgttgctattagatagggatttgccattggttcaggtgctcttgtgtccctagtgctgttttgtgc

SEQ ID NO: 6870 - DNA, 196 bp, Zea mays
  Clone ID: 700451045H1
ccacgatcatgacgtgagcaggaagcgcatgtctgaagatggtggatcctgttcgcaggcagttcaatatcagtcctgggttatatggctagacaagtcaatgccgatctacacagcctgtgtgaagagctctactgatgcttccatcaaggagatgattcctccgggcgcattgaacatagctgactccactcat

SEQ ID NO: 6871 - DNA, 96 bp, Zea mays
  Clone ID: 700454151H1
ggaggtccgtagctgctcatccgtggcatgatcttgagatcggtcctgatgctcctgctgtttccgaatgttgttgttcagatcacaaagggaagc

SEQ ID NO: 6872 - DNA, 199 bp, Zea mays
  Clone ID: 700454532H1
tagcgagtaatcggatcgtcaggagtccgtagtgtcatccgggatgatcttgagatcggtctgatgctctgctgttatcaatgttgttgttgagatcacaaagggaagcaacataaaatatgagctcgacaagaaaactggactgattaaggttgatcgagtcctgcactcatcagttgtatacccacacaattatggt

SEQ ID NO: 6873 - DNA, 267 bp, Zea mays
  Clone ID: 700475488H1
gcattcattactgctttccgctctggtgctgtgatgggcttcctgcttgctgctagtggcctttttgttctttatattgcaatcaacttgtttggaatttattatggtgatgactgggagggcctttatgaggctatcactggttatggtcttggtggttcttctatggctctttttggtcgtgttggtggtgggatttacactaaagctgctgatgttggtgctgatcttgttgggaaagtcgaaaggaatatccctgaagatgat

SEQ ID NO: 6874 - DNA, 284 bp, Zea mays
  Clone ID: 700552133H1
agcgacacggttggagacccattcaaagaagtacattgagactggtgcccttggtggcaaaggcagtgagtcccataaggctgcggttacaggcgacacggttggagacccattcaaagacactgcaggaccatcgctgcacgttcttatcaagatgctcgccacgatcacactggtcatggctcccatattcttgtgattaaccaaccagatttatcaagcttgccattaaccctgcggagatgtatctatgcgacttgtagatgaggtgtttacctgcatgt

SEQ ID NO: 6875 - DNA, 352 bp, Zea mays
  Clone ID: 700571086H1
gttggtgccatgctcccatactggttctcagcgatgacaatgaagagtgttggaagtgcagcactcaagatggttgaggaagtccgcaggcagttcaacaccatccctgggctcatggagggcattaccaagcctgactatgcgacgtgtgttaagatctctactgatgtatctatcaaggagatgatcccacctggtgcacttgtcatgcttacacctcttattgtggggatcttctttggtgttgaaaccctctctggagttcttgctggtgctcttgtttctggtgtccagattgccatctctgcatccaacactggaggtgcctgggacaacgctaagacatacattg

SEQ ID NO: 6876 - DNA, 338 bp, Zea mays
  Clone ID: 700572341H1
caaagttttcattggactgattgttggtgccatgctcccatactggttctcagcgatgacaatgaagagtgttggaagtgcagcactcaagatggttgaggaagtccgcaggcagttcaacaccatccctgggctcatggagggcattaccaagcctgactatgcgacgtgtgttaagatctctactgatgcatctatcaaggagatgatccacctggtgcacttgtcatgcttacacctcttattgtggggatctctttggtgttgaacctctctggagtcttgctggtgctcttgttctggtgtcagattgcactctgcatcaacactggagtgct

SEQ ID NO: 6877 - DNA, 132 bp, Zea mays
  Clone ID: 700611864H1
gcactgagaactcgatcgctggctagaacacaggtctctcattcacttccatgcgctccgtggccatcgccgtccccgaccgcagcgcaggactgaggataaatgaagaagttaaggttgctgcttctgctg

SEQ ID NO: 6878 - DNA, 220 bp, Zea mays
  Clone ID: 701166871H1
gatgaccattggcattgcgctcatgttggctaggtcttccatacaccttcagcatttataactttggagcccagaagacagtgcatagctggtacatgctaacaaaatttgattgaccattgaagattttagcataaagttaacattacaatctttctttgcgttaaattcatcaagcaactgttcttatgtgttgcagctgatatttatgctgggctaa

SEQ ID NO: 6879 - DNA, 333 bp, Zea mays
  Clone ID: 700622451H1
gccaccgatcgctcctctccactttccacattccagttccactccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactg

SEQ ID NO: 6880 - DNA, 340 bp, Zea mays
  Clone ID: 700571235H1
ctccgctgccggtcgccgactccgaaactccgacagtccgaccacaaggatccacagaaggatgagtgaagaggataaggctgctgcttctgctgagcagccgaagagggcccctaagctcaatgaaaggatcctctcttctctgtccaggaggtccgtagctgctcatccgtggcatgatcttgagatcggtcctgatgctcctgctgttttcaatgttgttgttgagatcacaaagggaagcaaagttaaatatgagctcgacaagaaaactggactgattaaggttgatcgagtcctgtactcatcagttgtataccctcacaattatggttcgtcc

SEQ ID NO: 6881 - DNA, 322 bp, Zea mays
  Clone ID: 700266126H1
gccaccgatcgctcctctccactttccacattccagttccactccgcctccgctgccggtcgccgactccgaaactccgacagtccgaccacaagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgatta

SEQ ID NO: 6882 - DNA, 357 bp, Zea mays
  unsure (1)...(357): unsure at all n locations
  Clone ID: 700621607H1
ccccancgatcgctcctctccactttccacattccagttccaacacgcctccgctgcaggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgattaaggttgatcgagtc

SEQ ID NO: 6883 - DNA, 309 bp, Zea mays
  Clone ID: 700345080H1
accagggtgaaaaggatgacaagataatagcagtctgtgctgatgatcctgaatatcgtcactacaacgacatcagtgagctgtctcctcatcgcctgcaagagatcaagcggttctttgaagattataagaagaatgagaataaagaggttgctgtcgatgcattcttgcctgcgaccacagctcgagaggccattcagtactccatggatctgtatgcgcagtatattttgcaaagcttgaggcagtagattggaagcaactatttatctgggcgtcttggaatgagtgtgattttaataagtcaaa

SEQ ID NO: 6884 - DNA, 312 bp, Zea mays
  Clone ID: 700624257H1
caaagttaaatatgagcttgacaagaaaactggactgattaaggttgatcgagtcctgtactcatcagttgtataccctcacaattatggtttcgttccaaggactctttgtgaagacaatgacccaatggatgtgttagtcctgatgcaggagcctgttgttcctggttcgttcctgcgagcaagagcaatcggccttatgctcatgattgaccagggtgaaaaggatgacaagataatagcagtctgtgctgatgatcctgaatatcgtcactacaacgacatcagtgagctgtctcctcatcgcctgca

SEQ ID NO: 6885 - DNA, 298 bp, Zea mays
  Clone ID: 700030359H1
tcgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgattaaggttgatcgagtcctgtactcatcagttgta

SEQ ID NO: 6886 - DNA, 297 bp, Zea mays
  Clone ID: 700214462H1
gcctccgctgccggtcgccgactccgaaactccgacagtccgaccacaaggatccacagaaggatgagtgaagaggataaggctgctgcttctgctgagcagccgaagagggcccctaagctcaatgaaaggatcctctcttctctgtccaggaggtccgtagctgctcatccgtggcatgatcttgagatcggtcctgatgctcctgctgttttcaatgttgttgttgagatcacaaagggaagcaaagttaaatatgagctcgacaagaaaactggactgattaaggttgatcga

SEQ ID NO: 6887 - DNA, 287 bp, Zea mays
  Clone ID: 700356050H1
ctccactttccacattccagttccactccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagca

SEQ ID NO: 6888 - DNA, 282 bp, Zea mays
  Clone ID: 701181128H1
gagcactttccacattccagttccactccgcctccgctgccggtcgccgtctccgagactccgacagtccgaccgcaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaaggg

SEQ ID NO: 6889 - DNA, 297 bp, Zea mays
  Clone ID: 700349795H1
ttaaggttgatcgagtcctttactcatcagttgtataccctcacaattatggtttcattccaaggactacttgtgaagacaatgacccaatggatgtgttggtcctgatgcaggagcctgttgttcctggttcgttcctgagagctagagcaattggccttatgcccatgattgaccagggtgaaaaggatgacaagataatagcagtatgtgctgacgatcctgaataccgtcactacaacgacatcagcgagctgtctcctcaccgcctgcaagagatcaagcgcttctttgaag

SEQ ID NO: 6890 - DNA, 279 bp, Zea mays
  Clone ID: 700473278H1
ctcgagccgctccactttccacattccagttccactccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttga

SEQ ID NO: 6891 - DNA, 272 bp, Zea mays
  Clone ID: 700157057H1
gcggttctttgaagattataagaagaatgagaataaagaggttgctgtcgatgcattcttgcctgcgaccacagctcgagaggccattcagtactccatggatctgtatgcgcagtatattttgcaaagcttgaggcagtagattggaagcaactatttatctgggcgtcttggaatgagtgtgattttaataagtcaaaacacttgatattgtgtgcaaatcttggggttgagaacaatgtcactagctgtgatttacttctgtgacttgc

SEQ ID NO: 6892 - DNA, 292 bp, Zea mays
  Clone ID: 700622505H1
ccacattccagttccactccgcctccgctgccggtcgccgactccgaaactccgacagtccgaccacaaggatccacagaaggatgagtgaagaggataaggctgctgcttctgctgagcagccgaagagggcccctaagctcaatgaaaggatcctctcttctctgtccaggaggtccgtagctgctcatccgtggcatgatcttgagatcggtcctgatgctcctgctgttttcaatgttgttgttgagatcacaaagggaggcaaagttaaatatgagctcgacaagaa

SEQ ID NO: 6893 - DNA, 266 bp, Zea mays
  Clone ID: 700219661H1
ccactttccacattccagttccactccgcctccgctgccggtcgccgactccgaaactccgacagtccgaccacaaggatccacagaaggatgagtgaagaggataaggctgctgcttctgctgagcagccgaagagggcccctaagctcaatgaaaggatcctctcttctctgtccaggaggtccgtagctgctcatccgtggcatgatcttgagatcggtcctgatgctcctgctgttttcaatgttgttgttgagatcacaaa

SEQ ID NO: 6894 - DNA, 284 bp, Zea mays
  Clone ID: 700619032H1
ccacattccagttccactccgcctccgctgccggtcgccgactccgaaactccgacagtccgaccacaaggatccacagaaggatgagtgaagaggataaggctgctgcttctgctgagcagccgaagagggcccctaagctcaatgaaaggatcctctcttctctgtccaggaggtccgtagctgctcatccgtggcatgatcttgagatcggtcctgatgctcctgctgttttcaatgttgttgttgagatcacaaagggaagcaaagttaaatatgagctc

SEQ ID NO: 6895 - DNA, 341 bp, Zea mays
  Clone ID: 700620065H1
ccaggttgctcctcatttccactttccactgcgcctccgctgcccatcgccgtccccgaccgcagcgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcatatacgagcttgacaagaaaactggactgattaaggttgatcgagtcctttactcatcagttgtatacctcac

SEQ ID NO: 6896 - DNA, 269 bp, Zea mays
  Clone ID: 700569179H1
attccactccgcctccgtgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagacgccaaagggaagcaaa

SEQ ID NO: 6897 - DNA, 255 bp, Zea mays
  Clone ID: 700156773H1
cctcacaattatggtttcgttccaaggactctttgtgaagacaatgacccaatggatgtgttagtcctgatgcaggagcctgttgttcctggttcgttcctgcgagcaagagcaatcggccttatgcccatgattgaccagggtgaaaaggatgacaagataatagcagtctgtgctgatgatcctgaatatcgtcactacaacgacatcagtgagctgtctcctcatcgcctgcaagagatcaagcggttcttt

SEQ ID NO: 6898 - DNA, 285 bp, Zea mays
  Clone ID: 700207120H1
ctcctctccactttccacattccagttccactccgcctccgctgccggtcgccgactccgaaactccgacagtccgaccacaagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcagagttaaatatga

SEQ ID NO: 6899 - DNA, 267 bp, Zea mays
  Clone ID: 700030407H1
agactccgaaactccgacagtccgaccacaagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaatgttaaatatgatcttgacaagaatactggactgatgaaggttgat

SEQ ID NO: 6900 - DNA, 266 bp, Zea mays
  Clone ID: 700457309H1
ggaggtccgtagctgctcatccgtggcatgatcttgagatcggtcctgatgctcctgctgttttcaatgttgttgttgagatcacaaagggaagcaaagttaaatatgagctcgacaagaaaactggactgattaaggttgatcgagtcctgtactcatcagttgtataccctcacaattatgtgttcgttccgaggactctttgtgaagacaatgacccaatggatgtgttagtcctgatgcaggagcctgttgttcctggttcg

SEQ ID NO: 6901 - DNA, 253 bp, Zea mays
  Clone ID: 700195681H1
gctgatgatcctgaatatcgtcactacaacgacatcagtgagctgtctcctcatcgcctgcaagagatcaagcggttctttgaagattataagaagaatgagaataaagaggttgctgtcgatgcattcttgcctgcgaccacagctcgagaggccattcagtactccatggatctgtatgcgcagtatattttgcaaagcttgaggcagtagattggaagcaactatttatctgggcgtcttggaatgagtg

SEQ ID NO: 6902 - DNA, 303 bp, Zea mays
  Clone ID: 700444838H1
gctgccgatcgccgtccccgaccgcagtgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaactggactgattaaggttgatcgagtcctttactcatcagttgtataccctca

SEQ ID NO: 6903 - DNA, 285 bp, Zea mays
  Clone ID: 700581619H1
cgaccaccgatcgctcctgagcactttccacattccagttccacaccgcctccgctgacggtcgccgtctccgagactccgacagtccgaccgcaagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagca

SEQ ID NO: 6904 - DNA, 303 bp, Zea mays
  unsure (1)...(303): unsure at all n locations
  Clone ID: 700351021H1
aagnaccaccgatcgctcctctccactttccacattccagttccactccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaaggga

SEQ ID NO: 6905 - DNA, 303 bp, Zea mays
  Clone ID: 700205723H1
acgcctccgctgccgatcgccgtccccgaccgcagtgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaactggactgattaaggttgatcgagtcctttactcatcagttgta

SEQ ID NO: 6906 - DNA, 267 bp, Zea mays
  Clone ID: 700159712H1
attccaaggactctttgtgaagacaatgacccaatggatgtgttggtcctgatgcaggagcctgttgttcctggttcgttcctgagagctagagcaattggccttatgcccatgattgaccagggtgaaaaggatgacaagataatagcagtatgtgctgacgatcctgaataccgtcactacaacgacatcagcgagctgtctcctcaccgcctgcaagagatcaagcgcttctttgaagattacaagaaaaacgagaacaaagaa

SEQ ID NO: 6907 - DNA, 263 bp, Zea mays
  Clone ID: 700158937H1
cctggtgctcctgctgtattcaatgttgttgttgagatcacaaagggaagcaaagtcaaatacgagcttgacaagaaaactggactgattaaggttgatcgagtcctttactcatcagttgtataccctcacaattatggtttcattccaaggactctttgtgaagacaatgacccaatggatgtgttggtcctgatgcaggagcctgttgttcctggttcgttcctgagagctagagcaattggccttatgcccatgattga

SEQ ID NO: 6908 - DNA, 273 bp, Zea mays
  Clone ID: 700336255H1
agcctccgctgccggtcgccgactccgaaactccgacagtccgaccacaagcaggatgagtgaagaggataagactgctgcttctgctgagcagccgaagagggcccctaagctcaatgaacggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggact

SEQ ID NO: 6909 - DNA, 276 bp, Zea mays
  Clone ID: 700422922H1
gtagctgctcatccatggcatgatcttgagatcggtcctgatgctcctgctgttttcaatgttgttgttgagatcaacagcgaagcaaagttaaatatgagcttgacaagaaaactggactgattaaggttgatcgagtcctgtactcatcagttgtataccctcacaattatggtttcgttccaaggactctttgtgaagacaatgacccaatggatgtgttagtcctgatgcaggagcctgttgttcctggttcgttcctggagcaagagcatc

SEQ ID NO: 6910 - DNA, 283 bp, Zea mays
  Clone ID: 700347429H1
ccactttccactgcacctccgctgcccatcgccgtccccgaccgcagcgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaactggactgatta

SEQ ID NO: 6911 - DNA, 251 bp, Zea mays
  Clone ID: 700350695H1
ctccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcac

SEQ ID NO: 6912 - DNA, 263 bp, Zea mays
  Clone ID: 700212988H1
ctttccactccgcctccgctgccgatcgccgtccccgaccgcagtgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaa

SEQ ID NO: 6913 - DNA, 296 bp, Zea mays
  unsure (1)...(296): unsure at all n locations
  Clone ID: 700345278H1
gccgatcgccgtccccgaccgcagtgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcanatacgagcttgacaagaagactggactgattaaggttgatcgagtcctttactcatcagttgtatacc

SEQ ID NO: 6914 - DNA, 221 bp, Zea mays
  Clone ID: 700264475H1
gtcattcagtactccatggatctgtatgcgcagtatattttgcaaagcttgaggcagtagattggaagcaactatttatctgggcgtcttggaatgagtgtgattctaataagtcaaaacacttgatattgtgtgcaaatcttggggttgagaacaatgtcactagctgtgatttacttctgtgacttgcattttttttcttgttaaattatgaataagcg

SEQ ID NO: 6915 - DNA, 313 bp, Zea mays
  Clone ID: 700211923H1
ctcatttccactttccactgcgcctccgctgcccatcgccgtccccgaccgcagcgcaggtgaggatccaaccccaacaaacttccaggcgacggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaa

SEQ ID NO: 6916 - DNA, 336 bp, Zea mays
  Clone ID: 700620974H1
ctactttccactccgcctccgctgccgatcgccgtccccgaccgcagtgcaggtgaggatccaaccccaacaaacttccaggcgacggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagataactggactgattaaggttgatcgagtccttt

SEQ ID NO: 6917 - DNA, 247 bp, Zea mays
  Clone ID: 700156401H1
ggatgacaagataatagcagtatgtgctgacgatcctgaataccgtcactacaacgacatcagcgagctgtctcctcaccgcctgcaagagatcaagcgcttctttgaagattacaagaaaaacgagaacaaagaagtcgcagttgatgcattcttgcccgcgacaacagctcaagaagccattcagtactccatggacctgtatgcccagtatattttgcaaagcttgaggcagtagattgcaagc

SEQ ID NO: 6918 - DNA, 221 bp, Zea mays
  Clone ID: 700172547H1
caatgttgttgttgagatcacaaagggaagcaaagtcaaatacgagcttgacaagaaaactggactgattaaggttgatcgagtcctttactcatcagttgtataccctcacaattatggtttcattccaaggactctttgtgaagacaatgacccaatggatgtgttggtcctgatgcaggagcctgttgttcctggttcgttcctgagagctagagcaa

SEQ ID NO: 6919 - DNA, 263 bp, Zea mays
  Clone ID: 700552384H1
gtagtgacgatattcaggatcatcagcacagactgctagagatcaagcggttctttgaagattataagaagaatgagaataaagaggttgctgtcgatgcattcttgcctgcgaccacagctcgagaggccattcagtactccatggatctgtatgcgcagtatattttgcaaagcttgaggcagtagattggaagcaactatttatctgggcgtcttggaatgagtgtgattttaataagtcaaaacactgatattgtgtgc

SEQ ID NO: 6920 - DNA, 258 bp, Zea mays
  Clone ID: 700219926H1
agcggagaacgaccccacggtgacgacatgcttgctctgctggactgttactctgagtaagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactgg

SEQ ID NO: 6921 - DNA, 209 bp, Zea mays
  Clone ID: 700357492H1
caagaaaactggactgattaaggttgatcgagtcctgtactcatcagttgtataccctcacaattatggtttcgttccaaggaatctttgtgaagacaatgacccaatggatgtgttagtcctgatgcaggagcctgttgttcctggttcgttcctgcgagcaagagcaatcggccttatgcccatgattgaccagggtgaaaaggatg

SEQ ID NO: 6922 - DNA, 274 bp, Zea mays
  Clone ID: 700343365H1
ctcatttccactttccactccgcctccgctgccgatcgccgtccccgaccgcagtgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgtggttgagatcacaaggggaagccaagtcaatacgagcttgacaaga

SEQ ID NO: 6923 - DNA, 240 bp, Zea mays
  Clone ID: 700018618H1
tcctgatgcaggagcctgttgttcctggttcgttcctgagagctagagcaattggccttatgcccatgattgaccagggtgaaaaggatgacaagataatagcagtatgtgctgatgatcctgaataccgtcactacaacgacatcagcgagctgtctcctcaccgcctgcaagagatcaagcgcttctttgaagattacaagaaaaacgagaacaaagaagtcgcagttgatgcattct

SEQ ID NO: 6924 - DNA, 313 bp, Zea mays
  Clone ID: 700570755H1
tccgcctccgctgccgatcgccgtccccgaccgcagtgcaggactgaggatgagtgaagaggataaggctgctgcttctgctgagcagcctaagagggcacctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagataactggactgattaaggttgatcgagtcctttactcatcagttgtataccctcac

SEQ ID NO: 6925 - DNA, 187 bp, Zea mays
  Clone ID: 700194777H1
caaggtcttgtgtgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgtt

SEQ ID NO: 6926 - DNA, 243 bp, Zea mays
  Clone ID: 700453790H1
ggatccaaccccaacaaacttccaggcgacggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaaaggaaagcaagtcaaatacgagcttgac

SEQ ID NO: 6927 - DNA, 261 bp, Zea mays
  Clone ID: 700197306H1
gttctagatcgcgagcaagagatcaagcggttctttgaagattataagaagaatgagaataaagaggttgctgtcgatgcattcttgcctgcgaccacagctcgagaggccattcagtactccatggatctgtatgcgcagtatattttgcaaagcttgaggcagtagattggaagcaactatttatctgggcggcttggaatgagtgtgatcctaataagccaaaacacttgatattgtgtgcaaatcttggggttgaga

SEQ ID NO: 6928 - DNA, 285 bp, Zea mays
  Clone ID: 700355750H1
gcgcctccgctgcccatcgccgtccccgaccgcagcgcaggtgaggatccaaccccaacaaacttccaggcgacggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagccaagtcaaatacgagcttt

SEQ ID NO: 6929 - DNA, 222 bp, Zea mays
  Clone ID: 700172940H1
cccacgagtccgcccacgcgtccgaaagaggttgctgacgatgcattcttgcctgcgaccacagctcgagaggccattcagtactccatggatctgtatgcgcagtatattttgcaaagcttgaggcagtagattggaagcaactatttatctgggcgtcttggaatgagtgtgattttaataagtcaaaacacttgatattgtgagcaattcggggggttg

SEQ ID NO: 6930 - DNA, 287 bp, Zea mays
  Clone ID: 700102133H1
attggaagcaactatttatctgggcgtcttggaatgagtgtgattttaataagtcaaaacacttgatattgtgtgcaaatcttggggttgagaacaatgtcactagctgtgatttacttctgtgacttgcattttttttcttgttaaattatgaataagcgaagtccatacgtctactgtgtggcttcttgctgggttcatcgtctacccatgttcctcaagcttgggaacatggggcctttccccatttccgtgtcttccatgcgaagtaaaatttatttgtatac

SEQ ID NO: 6931 - DNA, 176 bp, Zea mays
  Clone ID: 700350332H1
gggaagcaaagtcaaatacgagcttgacaagaaaactggactgattaaggttgatcgagtcctttactcatcagttgtataccctcacaattatggtttcattccaaggactctttgtgaagacaatgacccaatggatgtgttggtcctgatgcaggagcctgttgttcctggtt

SEQ ID NO: 6932 - DNA, 151 bp, Zea mays
  Clone ID: 700450285H1
tccagttccactccgcctccgctgccggtcgccgactccgaaactccgacagtccgaccacaaggtcttgtgcgggatccacagaaggatgagtgaagaggataagactgctgcttctgctgagcagccgaagagggcccctaagctcaat

SEQ ID NO: 6933 - DNA, 263 bp, Zea mays
  Clone ID: 700165003H1
gaacaaagaagtcgcagttgatgcattcttgcccgcgacaacagctcaagaagccattcagtactccatggacctgtatgcccagtatattttgcaaagcttgaggcagtagattgcaagcaacaatttatctatcatgcgtcttggatcggggcgtgattttaataagccgaatcgcttgctatattgcgaaccttggaattgagaacagcgtcactagctgtgattcgctcctttctcgttaaattatcatatgaataggc

SEQ ID NO: 6934 - DNA, 237 bp, Zea mays
  Clone ID: 700016136H1
gcacgagagaagtcgcagttgatgcattcttgcccgcgacaacagctcaagaagccattcagtactccatggacctgtatgcccagtatattttgcaaagcttgaggcagtagattgcaagcaacaatttatctatcatgcgtcttggatgggggcgtgattttaataagccaaatcgcttgctatattgggaaccttggaattgagaacagcgtcactagctgtgattcgctcctt

SEQ ID NO: 6935 - DNA, 166 bp, Zea mays
  Clone ID: 700171557H1
cggacgctgggcgagtcctttactcatcagttgtataccctcacaattatggtttcattccaaggacactttgtgaagacaatgacccaatggatgtgttggtcctgatgcaggagcctgttgttcctggttcgttcctgagagctagagcaattggccttatgcc

SEQ ID NO: 6936 - DNA, 237 bp, Zea mays
  Clone ID: 700238156H1
cagacgcgtggccgctgcccatcgccgtccccgaccgcagcgcaggtgaggatccaaccccaacaaaattccaggcgacggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgt

SEQ ID NO: 6937 - DNA, 137 bp, Zea mays
  Clone ID: 700425175H1
gtagctgctcatccatggcatgatcttgagatcggtcctgatgctcctgctgttttcaatgttgttgttgagatcacaaagggaagcaaagttaaatatgagcttgacaagaaaactggactgattaaggttaaccg

SEQ ID NO: 6938 - DNA, 191 bp, Zea mays
  Clone ID: 700354402H1
acactgcacctccgctgcccatcgccgtccccgaccgcagcgcaggactagtatgaggataaggctgctgcttctgctgagcagcctaagagggcccctaagctcaatgaaaggatcctctcctctctgtccaggaggtccgtagctgctcatccatggcatgatctcgagatcggtcctggtgctcctgc

SEQ ID NO: 6939 - DNA, 136 bp, Zea mays
  Clone ID: 700159204H1
gtgttggtcctgatgcaggagcctgttgttcctggttcgttcctgagagctagagcaattggccttatgcccatgattgaccagggtgaaaaggatgacaagataatagcagtatgtgctgacgatcctgaatacc

SEQ ID NO: 6940 - DNA, 160 bp, Zea mays
  Clone ID: 700623602H1
acggcccacctggaagccggagagaatcgagcagagccaccgatcgctcctctccactttccacattccagttccactccgcctccgctgccggtcgccgactccgaaactccgacagtccgaccacaaggatccacagaaggatgagtgaagaggataa

SEQ ID NO: 6941 - DNA, 155 bp, Zea mays
  Clone ID: 700612844H1
cgctcctctccactctccacattccagttccactccgcctccgctgccggtcgccgactccgatactccgacagtccgaccacaaggtcttgtgcgggatccacagaaggatgagtgaagaggataagactgctgcttctgctgagcagccgaag

SEQ ID NO: 6942 - DNA, 135 bp, Zea mays
  Clone ID: 700621062H2
ccaggttgctcctcatttccactttccactgcggctccgctgcccatcgccgtccccgaccgcagcgcaggactgaggatgagtgaagaggataaggctgctgcttctgctgagcagcctaagagggcccctaag

SEQ ID NO: 6943 - DNA, 186 bp, Zea mays
  Clone ID: 700335685H1
agagaatcgagcagagccacccggctgctcctcatttccactttccactccgcctccgctgccgatcgccgtccccgaccgcagtgcaggactgaggatgagtgaagaggataaggctgcagcttctgctgagcagcctaagagggcccctaagctcaatgaaaggatcctctcctctctgtccag

SEQ ID NO: 6944 - DNA, 255 bp, Zea mays
  Clone ID: 700454845H1
cttgtgcttggtgcagtcacctcactagtttccggctttcttggaatgaagatcgcaacttatgcgaatgcccggacaactttagaggccagaaagggtgtcggaaaggcatttattactgccttccgagctggtgcagtaatgggcttcctgcttgctgccagcggtcttttggttctttacattgctatcaatttgtttggacattattacggtgatgactgggaaggtctttttgaagctattactggttat

SEQ ID NO: 6945 - DNA, 260 bp, Zea mays
  Clone ID: 700455149H1
cacaaagagtcaaccttgccactattagaaggacaagacttgcaagcctgcccttgctaatgccatcttcagtactatagcttttgtgcttggtgcggtcacctcactggtttctggttttcttggaatgaagatagcaacttatgctaatgcccggacaactttagaggctagaaagggcgtcgggaaggcatttattactgccttccgatctggtgcattatgggcttcctgcttgctgccagcggtcttttggttct

SEQ ID NO: 6946 - DNA, 137 bp, Zea mays
  Clone ID: 700455537H1
cataaagagtcaaccttgccactatagcaaggacaagacttgcaagcctgcccttgctaatgccatcttcagtactatagcttttgtgcttggtgcggtcacctcactggtttctggttttcttggaatgacgatag

SEQ ID NO: 6947 - DNA, 138 bp, Zea mays
  Clone ID: 700615620H1
cagtactatagcttttgtgcttggtgcagtcacctcactagtttccggctttcttggaatgaagatcgcaacttatgcgaatgcccggacaactttagaggccagaaagggtgtcggaaaggcatttattactgcctt

SEQ ID NO: 6948 - DNA, 249 bp, Zea mays
  unsure (1)...(249): unsure at all n locations
  Clone ID: 700454648H1
tcgcctgcaccgcgctacgtncagactcaggacattacggactacgacgctttgctgcctatggtcgcacgtcacctacaactacgtttaccggactttactatggacatgacagatacgaccacttcatgcgaatgcccggacaactttagaggccagaacgggtgtcggaacggcatttattactgccttccgagctggtgcagtaatgggcttcctgcttgctgccagcggtcttttggtatttac

SEQ ID NO: 6949 - DNA, 303 bp, Zea mays
  Clone ID: 700334949H1
aaccgctccgccacctcgccactcgcctcttctcgctctcgccaccgggccagggaagggaccatccgatcggatccgtcatggctggagctgctgctctcaatgagggtatcctttcttccgtgtccgagaaaaatgttgctgctcacccatggcatgatttggagataggaccagaggctcctgcagtgttcaattgtgtggttgagattcctagaggcagcaaggttaagtatgagttggacaagatatctggtctgatcaaggtggatcgtgtcctttactcctctgttgtttacccac

SEQ ID NO: 6950 - DNA, 290 bp, Zea mays
  Clone ID: 700346817H1
ctcgaggccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatctggtctgatcaaggtggatcgtgtcctttact

SEQ ID NO: 6951 - DNA, 309 bp, Zea mays
  Clone ID: 700103380H1
tggacagcagcagtgaactcgacgccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatctggtctgatcaaggtggatcgtgtcctttactcc

SEQ ID NO: 6952 - DNA, 258 bp, Zea mays
  Clone ID: 700348280H1
ctcgaggccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatc

SEQ ID NO: 6953 - DNA, 293 bp, Zea mays
  Clone ID: 700453203H1
tgcagcagtgaactcgaggccgctccgccacctcgccactcgcctcttctcgctctcgccaccgggccaggtgaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatctggtctgatcaaggtggatcgt

SEQ ID NO: 6954 - DNA, 315 bp, Zea mays
  Clone ID: 700381101H1
gccctggacagcagcagcgaactcgaggccgctccgccacctcgccactcgcctcttctcgctctcgccaccgggccaggggcgggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaagatatctggtctgatacaggtggatcgtgtcctttactcctc

SEQ ID NO: 6955 - DNA, 254 bp, Zea mays
  Clone ID: 700347617H1
ctcgaggccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggttaagtatgagttggacaaga

SEQ ID NO: 6956 - DNA, 266 bp, Zea mays
  Clone ID: 700043259H1
cgccccggagccctggacagcagcagtgaactcgaggccgctccgccacctcgccactcgcctcttctcgctctcgccaccgggccagggaagggaccatccgatcggctccgtcatggctggagctgctgctctcaatgagggtatcctttcttccgtgtccgagaaaaatgttgctgctcacccatggcatgatttggagataggaccagaggctcctgaagtgttcaattgtgtggttgagattcctagaggcagcaaggtta

SEQ ID NO: 6957 - DNA, 260 bp, Zea mays
  Clone ID: 701184447H1
ggagccctggacagcagcagtgaactcgaggccgctccgccacctcgccactcgcctcttctcgctctcgccaccgggccagggaacggaccatccgatcggctccgtcatggctggagctgctgctctcaatgagggtatcctttcttccgtgtccgagaaaaatgttgctgctcacccatgcattgatttggagataggaccagaggctcctgaagtgttcaattgtgtggttgagattcctagaggcagcaaggtta

SEQ ID NO: 6958 - DNA, 278 bp, Zea mays
  Clone ID: 700355977H1
ggcggcacaagaacggctacggcggctacctcatcgaggaggaggaggggctcaacgaccacaacgtcgtcgtcaagtgcgccgagatccagaccgctatctccgaagggcaacatcgtttcttttcactgagtaccaatatgttggtatcttcatgtccatctttgctgttgtgatcttcctcttccttggttcggttgacggattcagcacgaagagccagccctgcacctatagcaaggacaagtactgcaagcctgcactgttcactgcactct

SEQ ID NO: 6959 - DNA, 299 bp, Zea mays
  Clone ID: 700265262H1
gcaagaacggctacggcgactacctcatcgaggaggaggaggggctcaacgaccacaacgtcgtcgtcaagtgcgccgagatccagaccgctatctccgaagagcaacatcgtttcttttcactgagtaccaatatgttggtatcttcatgtccatctttgctgttgtgatcttcctcttccttggttcggttgagggattcagcacgaagagccagccctgcacctatagcaaggacaagtactgcaagcctgcactgttcactgtactctttagcactgtggtcttcttgcttggag

SEQ ID NO: 6960 - DNA, 299 bp, Zea mays
  Clone ID: 700075743H1
gccaggaccctcggccccaagggatctgactgccacaaggctgctgtgataggtgacaccattggtgaccccctgaaggacacctcgggcccgtccctcaacatcctgatcaagctcatggcggtggagtcccttgtgtttgcccccttcttcgccacccacggtggcctgctgttcaagtacctgtaagggccacaccaatcatcacagcagaaatatacgaccgaccgaccgtggacatctcgaataactcctgccaaatcgccagttcatgtgtattgtgcgctagcgcctagctg

SEQ ID NO: 6961 - DNA, 345 bp, Zea mays
  Clone ID: 700571658H1
attggtgacccctgaaggacacctcgggcccgtccctcaacatcctgatcaagctcatggcggtggagtgcttgtatttgctcccttcttcgccacccacggtggcctgctgttcaagtatctgtaagggccacaccaatcatcacagcagaaatatacgaccgaccgaccgtggacatctcgaataactcctgccaaatcgccagttcatgtgtattgtgcgctagccgcctagctgcactgctgttttatcggtctcattgttcgtattctctccttggcacctccccctagaggcgttactgttagccttactcttactcgctgtagctgcacgtagaagag

SEQ ID NO: 6962 - DNA, 296 bp, Zea mays
  Clone ID: 700088795H1
ggcagacctctggcttggtggacgagtctggcaacccaactggtggtctttttgggacagctgtagcaacaatggggatgcttagcactgcagggtatgttctcaccatggacatgtttggtcctatagctgacaacgctggtggtattgttgagatgagccagcagcctgaaagtgtgagggaaatcacagatgttctagatgctgtgggcaacacaactaaagctactacgaaaggatttgccatagggtcagcagctctggcttccttcctcctgtttagtgcatatatggat

SEQ ID NO: 6963 - DNA, 278 bp, Zea mays
  Clone ID: 700241354H1
gttgccattatatcagcatattggctggggcagacctctggcttggtggacgagtctggcaacccaactggtggtctttttgggacagctgtagcaacaatggggatgcttagcactgcagggtatgttctcaccatggacatgtttggtcctatagctgacaacgctggtggtattgttgagatgagccagcagcctgaaagtgtgagggaaatcacagatgttctagatgctgtgggcaacacaactaaagctactacgaaaggatttgccatagg

SEQ ID NO: 6964 - DNA, 283 bp, Zea mays
  Clone ID: 700050595H1
gcgctcgaacgaactccacacgaaattatccgcgtaaagttggggagcagcgaacccgtagcgcgcgccccggatccctccacggggggcaatggcctcgtcggcgttcctgcccgagctgggcacgcaggtggtggtgcccgtcgcggccgtggtaggcatcgcgttcgcggtgctgcagtgggtgctggtctccaaggtgaagctctcccccgagccgcgccgcggagacggctccgccgggaagagcggcgccggcgccggcgccagcgagtacctcatc

SEQ ID NO: 6965 - DNA, 289 bp, Zea mays
  Clone ID: 700090051H1
gccgtgcgctcgaacgaactccacacgaaattatccgcgtaaagttggggagcagcgaacccgtagcgcgcgccccggatccctccacggggggcaatggcctcgtcggcgttcctgcccgagctgggcacgcaggtggtggtgcccgtcgcggccgtggtaggcatcgcgttcgcggtgctgcagtgggtgctggtctccaaggtgaagctctcccccgagccgcgccgcggagacggctccgccgggaagagcggcgccggcgccggcgcagcgtagtacctcatcg

SEQ ID NO: 6966 - DNA, 277 bp, Zea mays
  Clone ID: 700423113H1
atcacccatggccgttggcgttgtcttccggattttgggccactacactggtcagcctcttcttggagctaaagttgtagcctccatgctgatgtttgcgacggtcgctgggattctcatggcactcttgcttgaacactgctggcggcgcctgggataatgcaaagaagtacattgagactggcgctcttggtggcaagggcagcgagtcccacaaggctgcggttactggcgacacggttggagacccattcaaagacactgctggaccgtcgct

SEQ ID NO: 6967 - DNA, 265 bp, Zea mays
  Clone ID: 700577157H1
ttttgtttcaattgtcaggtggttgagattcctagaggcagcaaggttaagtacgagttggacaaggcatctggtctgatcaaggtggaccgtgttctttattcctctgttgtttacccacataactatggcttcattccacgcacactctgtgaggataacgaccccctggatgtcctcatactgatgcaggaacaagttgtccctgggtgtttcctgcgagctcgtgctattgggctcatgcctatgatcgatcagggcgaga

SEQ ID NO: 6968 - DNA, 302 bp, Zea mays
  Clone ID: 700099364H1
cacactgatccggcctggagcgctggacagcagcagcagcatcgagctcgaggccgctccgccaccccgcactcgcctgtcgcctcttctcgctttcgccaccggggcagcgctccgccatggctggacctgctgttctcaatgagcgtatcctttcttccatgtcccagaaacatgttgctgctcacccatggcatgatttggagataggaccaggggctcctgaattcttcaattgtgtggttgagattcctagaggcagcaaggttaagtacgagttggacaaggcatctggtctgatc

SEQ ID NO: 6969 - DNA, 287 bp, Zea mays
  Clone ID: 700336387H1
gctcgaggccgctcgccaccccgcactcgcctgtagcctcttctcgctttcgccaccggggcagcgctccgccatggctggacctgctgttctcaatgagcgtatcctttcttccatgtctcagaaacatgttgctgctcacccatggcatgatttggagataggaccaggggctcctgaattcttcaattgtgtggttgagattcctagaggcagcaaggttaagtacgagttggacaaggcatcttgtctgatccaggtcgacgtgttctttattcctctggtgg

SEQ ID NO: 6970 - DNA, 266 bp, Zea mays
  Clone ID: 700217095H1
cccacgcgtccgcacactgatccggcctggagcgctggacagcagcagcagcagcagcatcgagctcgaggccgctccgccaccccgcactcgcctgtcgcctcttctcgctttcgccaccggggcagcgctccgccatggctggacctgctgttctcaatgagcgtatcctttcttccatgtcccagaaacatgttgctgctcacccatggcatgatttggagataggaccaggggctcctgaattcttcaattgtgtggttgag

SEQ ID NO: 6971 - DNA, 239 bp, Zea mays
  Clone ID: 700155869H1
cccacgcgtccgatcacactgatccggcctggagcgctggacagcagcagcagcagcagcatcgagctcgaggccgctccgccaccccgcactcgcctgtcgcctcttctcgctttcgccaccggggcagcgctccgccatggctggacctgctgttctcaatgagcgtatcctttcttccatgtcccagaaacatgttgctgctcacccatggcatgatttggagataggaccagggg

SEQ ID NO: 6972 - DNA, 211 bp, Zea mays
  Clone ID: 700575534H1
tgatccggcctggagcgctggacagcagcagcagcatcgagctcgaggccgctccgccaccccgcactcgcctgtcgcctcttctcgctttcgccaccggggcagcgctccgccatggctggacctgctgttctcaatgagcgtatcctttcttccatgtcccagaaacatgttgctgctcacccatggcatgatttggagataggaccag

SEQ ID NO: 6973 - DNA, 260 bp, Zea mays
  Clone ID: 700163562H1
gacagcagcagcagcagcagcatcgagctcgaggccgctccgccaccccgcactcgcctgtcgcctcttctagctttcgccaccggggcagcgctccgccatggctggacctgctgttctcaatgagcgtatcctttcttccatgtcccagaaacatgttgctgctcacccatggcatgatttggagataggtggttgagattcctagaggcagcaaggttaagtacgagttggacaaggcatctggtctgatcaaggtg

SEQ ID NO: 6974 - DNA, 319 bp, Zea mays
  Clone ID: 700076138H1
gctgccactaatgtcatttttggtcttgctcttggatacaagtcagttatcatcccgattttcgctatcgctgttagcatctatgtcagtttctccattgctgcaatgtacggcatcgcagttgccgctcttggtatgctgagcacaatcgcaactggtcttgctattgatgcttatggtcccatcagtgacaatgctggtggtattgctgagatggctggaatgagtcacagaatccgtgagagaactgatgctcttgatgctgctggcaacaccactgccgctattggaaagggatttgccattggttcagctgctc

SEQ ID NO: 6975 - DNA, 309 bp, Zea mays
  Clone ID: 700381158H1
ttcgcagttgccgctcttggtatgctgagcacaattgcaactggtcttgctattgatgcttatggtcccatcagtgacaatgctggtggtattgctgagatggctggaatgagtcacagaatccgtgagagaactgatgctcttgatgctgctggcaacaccactgccgctattggaaagggatttgccattggttcagctgctcttgtgtctctggcgctttttggtgccttcgtcagcagagctggagtgaaggttgtcgatgtcctctcccccaaggttttcattggtttgattgttggagccatg

SEQ ID NO: 6976 - DNA, 292 bp, Zea mays
  Clone ID: 700050877H1
gtttctccattgctgcgatgtacggcattgcagttgccgctcttggtatgctgagcacaatcgcaactggtcttgctattgatgcttatggtcccatcagtgacaatgctggtggtattgctgagatggctggaatgagccacagaatccgtgagagaactgatgctcttgatgctgctggcaacacaactgctgctattggaaaggggtttgccattggttcagctgctcttgtgtccctggcgctttttggtgcctttgtcagcagagctggagtgaaggtcgtcgacgt

SEQ ID NO: 6977 - DNA, 295 bp, Zea mays
  Clone ID: 700450220H1
tctatgtcagtttctccattgctgcaatgtacggcatcgcagttgccgctcttggtatgctgagcacaatcgcaactggtcttgctattgatgcttatggtcccatcagtgacaatgctggtggtattgctgagatggctggaatgagtcacagaatccgtgagagaactgatgctcttgatgctgctggcaacaccactgccgctattggaaagggatttgccattggttcagctgctcttgtgtctctggcgctttttggtgcctttgtcagcagagctggagtgaaggttgt

SEQ ID NO: 6978 - DNA, 332 bp, Zea mays
  unsure (1)...(332): unsure at all n locations
  Clone ID: 700050516H1
ctggaatgagtcacagaatccgtgagagaactgatgctcttgatgctgctggcaacaccactgccgctattggaaagggatttgccattggttcagctgctcttgtgtctctggcgctttttggtgccttcgtcagcagagctggagtgaaggttgtcgatgtcctctcccccaaggttttcattggtttgattgttggagccatgcttccctattggttctctgccatgaccatgaagagtgttggaagtgccgccctaaagatggtggaggaggtccgcagacagttcaacaccattcctgngttgatggagggaactgccaagcctgac

SEQ ID NO: 6979 - DNA, 185 bp, Zea mays
  Clone ID: 700620486H1
cggcattgcagttgccgctcttggtatgctgagcacaatcgcaactggtcttgctattgatgcttatggtctcatcagtgacaatgctggtggtattgctgagatggctggaatgagccacagaatccgtgagagaactgatgctcttgatgctgctggcaacacaacgctgctattggaaaggg

SEQ ID NO: 6980 - DNA, 307 bp, Zea mays
  Clone ID: 700474550H1
aacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccagaagacagtgcaaagctggcaattgttcttgtgtgtggcggttggtctctgggctggcctagtcattggttttgttactgagtactacacaagctatgcctacagccctgtacaagatgttgctgattcctgcagaactgga

SEQ ID NO: 6981 - DNA, 284 bp, Zea mays
  Clone ID: 700218212H1
attatagcatgtctcataacaacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccagaagacagtgcaaagctggcaattgttcttgtgtgtggcggttggtctctgggctggcctagtcattggttttgttactgagtactacacaagcaatgc

SEQ ID NO: 6982 - DNA, 290 bp, Zea mays
  Clone ID: 700468143H1
gtttgaagctattactggttatggccttggtggttttctatggctcttttcggccgcgttggtggtggtatttataccaaggctgctgatgttggtgctgaccttgtggggaaggtagaaagaaacattcctgaggacgatccaagaaacccagctgttattgctgacaatgttggtgataatgttggagatattgctggaatgggatcagatctctttggctcatatgctgaatcatcatgtgctgctcttgttgtggcctctatctcgtcttttggaatcaacctgaa

SEQ ID NO: 6983 - DNA, 299 bp, Zea mays
  Clone ID: 700101735H1
aatttattacggtgatgactgggaaggtctttttgaagctattactggttatggccttggtggttcttctatggctcttttcggccgcgttggtggtggtatttataccaaggctgctgatgttggtgctgaccttgtggggaaggtagaaagaaacattcctgaggacgatccaagaaacccagctgttattgctgacaatgttggtgataatgttggagatattgctggaatgggatcagatccctttggctcatatgctgaatcatcatgtgctgctcttgttgtggcctctatct

SEQ ID NO: 6984 - DNA, 281 bp, Zea mays
  Clone ID: 700454255H1
ggaagttcgtcggcagttcaacaacatccctgggctcatggaaggcaccacaaagcctgactacgcaacttgtgtcaagatctcaacggatgcatccatcaaggagatgatccccccaggtgctcttgttatgctcacaccactgatcgttgggattctatttggggttgagaccctctctggagtccttgctggtgcccttgtctctggtgttcagattgccatttctgcatccaacactggtggtgcctgggacaacgccaagaagtacattgaggctg

SEQ ID NO: 6985 - DNA, 285 bp, Zea mays
  Clone ID: 700051815H1
ccgctcgagcggctcgagcacaaagcctgactacgcaacttgtgtcaagatctcaacggatgcatccatcaaggagatgatccccccaggtgctcttgttatgctgacaccactgatcgttgggattttgtttggggttgagaccctcgctggggtccttgctggtgcccttgtctctggtgttcagattgccatttctgcatccaacactggtggtgcctgggacaacgccaagaagtacattgaggctggagcttcagagcatgccaggacccttggcccaaa

SEQ ID NO: 6986 - DNA, 340 bp, Zea mays
  Clone ID: 700623739H1
cagctctgtacaagatgttgctaattcctgcagaactggagcagctactaatgtcatttttgggcttgctttgggttacaaatcagctcttatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgatatggctgggatgagccataggattcgtgagagaactgatgctctagatgctgcaggaaataccacggctgcaattgggaagggtttg

SEQ ID NO: 6987 - DNA, 270 bp, Zea mays
  Clone ID: 700577880H1
atctggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccataggattcgtgagagaactgatgctctagatgc

SEQ ID NO: 6988 - DNA, 273 bp, Zea mays
  Clone ID: 700457170H1
ctaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccataggattcgtgagagaactgatgctctagatgctgcaggaaataccacgg

SEQ ID NO: 6989 - DNA, 290 bp, Zea mays
  Clone ID: 700476606H1
gagatattgttggaatgggatcatatctctttggctcatatgctgaattgtcatgtgctgctcttgttgtggcctcgatctcgtcttttggaatcaaccatcaatttactccaatggtgtatccccttcttgtcagctctgttggtattatagcatgtctcataacaacgctgtttgcaactgatttcttcgagataaaggctgtgagtgaaatagagcctgctctcaagaaacaacttataatatccactgttgtgatgaccattggcattgcgctcatgttggcttgg

SEQ ID NO: 6990 - DNA, 332 bp, Zea mays
  Clone ID: 700620920H1
gaagagtgtgggcagtgctgcgctcaagatggtggaggaagttcgtcggcagttcaacaacatccctgggctcatggaaggcaccacaaagcctgactacgcaacttgtgtcaagatctcaacggatgcatccatcaaggagatgatccccccaggtgctcttgttatgctcacaccactgatcgttgggattctatttggggttgagaccctctctggagtccttgctggtgcccttgtctctggtgttcagattgccatttctgcatccaacactggtggtgcctgggacaacgccaagaagtacattgaggctggagtttcagagcatg

SEQ ID NO: 6991 - DNA, 299 bp, Zea mays
  Clone ID: 700100479H1
gctgaaatggctgggatgagccataggattcgtgagagaactgatgctctagatgctgcaggaaataccacggctgcaattgggaagggttttgccattggctctgcagccttggtttcccttgcactatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagtt

SEQ ID NO: 6992 - DNA, 265 bp, Zea mays
  Clone ID: 700551082H1
gtattacacaagcaatgcatacagtcctgtacaggatgttgctgattcctgcagaactggagctgctacgaatgtcatctttggccttgctctgggatataaatccgtcattatccctatttttgctattgcttttagtatttttctcagcttcagccttgctgccatgtacggtgttgctgtggctgctcttggaatgctcagcacaatcgctactggccttgccattgatgcctatggtcctatcagtgacaatgctggagga

SEQ ID NO: 6993 - DNA, 256 bp, Zea mays
  Clone ID: 700156615H1
gcagaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagcataggattcgtgagaga

SEQ ID NO: 6994 - DNA, 234 bp, Zea mays
  Clone ID: 700161538H1
ctcacaccactgatcgttgggattctatttggggttgagaccctctctggagtccttgctggtgcccttgtctctggtgttcagattgccatttctgcatccaacactggtggtgcctgggacaacgccaagaagtacattgaggctggagtttcagagcatgccaggacccttggcccaaaaggttctgaccctcacaaggcggctgtcattggtgacaccattggagatcct

SEQ ID NO: 6995 - DNA, 251 bp, Zea mays
  Clone ID: 700157125H1
gcagaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccataggattcgt

SEQ ID NO: 6996 - DNA, 250 bp, Zea mays
  Clone ID: 700173068H1
agatgttgctaattcctgcagaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctggg

SEQ ID NO: 6997 - DNA, 301 bp, Zea mays
  Clone ID: 700050620H1
agaaatagagcctgctctcaagagacaacttataatatccactgttgtgatgaccattggcattgcgctcatgttggcttggtcttccatacaccttcaccatttataactttggagcccagaagacagtgcaaagctggcaattgttcttatgtgtggcggttggtctctgggctggcttagtcattggttttattactgagtactacacaagcaatgcctacagccctgtataagatgttgctgattcctgcagaactggagctgccactaatgtcattttagggcttgctctgggtta

SEQ ID NO: 6998 - DNA, 284 bp, Zea mays
  unsure (1)...(284): unsure at all n locations
  Clone ID: 700622261H1
caacgctgtttgcaactgatttcttcgagataaaggctgtggatgaaatagagcctgctctcaagaaacagctcataatttccacaattgtgatgaccaatggcattgcactaatcagttggcttggtcttccatacactttcactattttcaactttggagtccagaagacagtgncaagctggcaattgttcttgtgtgtggcgttggtctctgggctggcctagtcattggtttgctactgagtactacacagcaatgcctacagccctgtacaagatgtt

SEQ ID NO: 6999 - DNA, 260 bp, Zea mays
  Clone ID: 700043120H1
tatggccctatcagtgataatgctggaggaatagctgaaatggctgggatgagccataggattcgtgagagaactgatgctctagatgctgcaggaaataccacggctgcaattgggaagggttttgccattggctctgcagccttggtttcccttgcactatttggtgcgtttgtaagccgggctgctatctccactgttgatgttctgactcctaaagtattcatcgggcttattgtcggtgctatgctcccgtactg

SEQ ID NO: 7000 - DNA, 197 bp, Zea mays
  Clone ID: 700215855H1
gttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccag

SEQ ID NO: 7001 - DNA, 281 bp, Zea mays
  Clone ID: 700098048H1
gaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccataggattcgtgagacgactgatgctctagatgctgcagaaata

SEQ ID NO: 7002 - DNA, 235 bp, Zea mays
  Clone ID: 700021133H1
gcacgaggtttgcaactgatttcttcgagataaaggctgtgagtgaaatagagcctgctctcaagaaacaacttataatatccactgttgtgatgaccattggcattgcgctcatgttggcttggtcttccatacaccttcaccatttatgactttggagcccagaagacagtgcaaagctggcaattgttcttgtgtgtggcggttggtctctgggctggcttagtcattggtt

SEQ ID NO: 7003 - DNA, 241 bp, Zea mays
  Clone ID: 700021236H1
gcacgagaggtcttgctattgatgcatatggccctatcagtgataatgctggaggaatagctgaaatggctgggatgagccataggattcgtgagagaactgatgctctagatgctgcaggaaataccacggctgcaattgggaagggttttgccattggctctgcagccttggtttcccttgcactatttggtgcgtttgtaagccgggctgctatctccactgttgatgttctgactcc

SEQ ID NO: 7004 - DNA, 271 bp, Zea mays
  unsure (1)...(271): unsure at all n locations
  Clone ID: 700431153H1
agtctctggtgttcagattgccatttctgcatccaacactggtggtgcctgggacaacgccaagaagtacattgaggctggagtttcagagcatgccaggacgcttggcccaaaaggttctgacccttgtatatangtgtcattggtgacaccattggagatcctctcaaggacacgtctggcgcttccctcaacatcctcatcaagcttatggcggttgaatcccttgtcttcgccccttcttcgccgcccatggtggcattctcttcaa

SEQ ID NO: 7005 - DNA, 262 bp, Zea mays
  Clone ID: 700441425H1
atttattactgccttccgagctggtgcagtaatgggcttcctgcttgctgccagctgtcttttggttctttacattgctatcaatttgtgtggaatttattacggtgatactgggaaggtctttttgaagctattactggttatggccttggtggttcttctatggctcttttcggccgcgttggtggtggtatttataccaaggctgctgatgttggtgctgaccttgtggggtaggtagaaagaaacattcctgaggacg

SEQ ID NO: 7006 - DNA, 249 bp, Zea mays
  Clone ID: 700160941H1
cttgtctctggtgttcagattgccatttctgcatccaacactggtggtgcctgggacaacgccaagaagtacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttc

SEQ ID NO: 7007 - DNA, 211 bp, Zea mays
  Clone ID: 700160760H1
ctgatgctctagatgctgcaggaaataccacggctgcaattgggaagggttttgccattggctctgcagccttggtttcccttgcactatttggtgcgtttgtaagccgggctgctatctccactgttgatgttctgactcctaaagtattcatcgggcttattgtcggtgctatgctcccgtactggttctcggcaatgaccatgaagag

SEQ ID NO: 7008 - DNA, 246 bp, Zea mays
  Clone ID: 700439081H1
ctgaactagagcctgctctcaagatacagctcataatttccaccattgtgatgaccattggcattgcactaatcagttggcttggtcttccatacactttcacgattttcaactatggagtccataagatcgtgctaagctggcaattgttcttgtgtgtggcggttggtctctgggctggcctagtcatcggttttgtgactgagtactacacaagcaatgcctacagccctgtacaagatgttg

SEQ ID NO: 7009 - DNA, 282 bp, Zea mays
  Clone ID: 700444194H1
ctggtggtgcctgggacaacgccaagaagtacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcgagagacgcaggataaaggccgtagttttgc

SEQ ID NO: 7010 - DNA, 283 bp, Zea mays
  Clone ID: 700217965H1
cggacgcgtgggcggacgcgtgggcggacgcgtgggtacagtcctgtacaggatgttgctgactcctgcagagctggagctgcaccgaatgtcatatttggccttgctctgggatataaatccgtcattatccctatttttgctattgcttttagtattttcctcagcttcagtcttgctgccatgtacggtgttgctgtggctgctcttggaatgctcagcacaatcgctactggccttgccattgatgcctatggtcctatcagtgacaatgctggaggaa

SEQ ID NO: 7011 - DNA, 274 bp, Zea mays
  Clone ID: 700456962H1
gctgaaatggctgggatgagccataggattcgtgagagaactgatgctctagatgctgcaggaaataccacggctgcaattgggaagggttttgccattggctctgcagccttggtttcccttgcaacatttggtgctttgtaaaccggggtggtatctccactgtttatggtctgactcctaaagtattcatcgggcttattgtcggtgctatgctcccgtactggttctcggcaatgaccatgaagagtgtgggcagtgctgcgctcaaaat

SEQ ID NO: 7012 - DNA, 174 bp, Zea mays
  Clone ID: 700438388H1
attacggtgatgactgggaaggtctttttgaagctattactggttatggccttggtggttcttctatggctcttttcggccgcgttggtggtggtatttataccaaggctgctgatgttggtgctgaccttgtggggaaggtagaaagaaacattcctgaggacgatccaagaa

SEQ ID NO: 7013 - DNA, 252 bp, Zea mays
  Clone ID: 700623436H1
tggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcgagagacgcaggataaaggccgtagttttgcaaggcgagta

SEQ ID NO: 7014 - DNA, 130 bp, Zea mays
  Clone ID: 700472039H1
gaagctattactggttatggccttggtggttcttctatggctcttttcggccgcgttggtggtggtatttataccaaggctgctgatgttggtgctgaccttgtggggaaggtagaaagaaacattcctg

SEQ ID NO: 7015 - DNA, 244 bp, Zea mays
  Clone ID: 700624180H1
aaaaggttctgaccctcacaaggcggctgtcattggtgacaccattggagatcctctcaaggacacgtctggcccttccctcaacatcctcatcaagcttatggcggttgaatcccttgtcttcgcccccttcttcgctgcccatggtggcattctcttcaaatggctctaagccagcgaggcacgcaggataaaggccgtagttttgcaaggcgagtagagcagtatgtcagtaatacagcat

SEQ ID NO: 7016 - DNA, 236 bp, Zea mays
  Clone ID: 700162157H1
ctcaaggacacgtctggcccttccctcaacatcctcatcaagcttatggcggttgaatcccttgtcttcgcccccttcttcgccgcccatggtggcattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgta

SEQ ID NO: 7017 - DNA, 78 bp, Zea mays
  Clone ID: 700162372H1
gggacaacgccaagaagtacattgaggctggagtttcagagcatgccaggacccttggcccaaaaggttctgaccctc

SEQ ID NO: 7018 - DNA, 340 bp, Zea mays
  Clone ID: 700624482H1
cttcgctgtgtgtgatcttcctcttccttggttcggttgagggattcagcacgaagagccagccctgcacatatagcaaggacaagtactgcaagcctgcgctgttcactgcactctttagcactgtgtccttcttgcttggagccatcacctctctggtctctggtttccttggcatgaagattgccacatatgcgaatgccagtgttaccctggaagctaggaagggtgttggcaaggcttttatcactgctttccgctctggcgctgttatgggtttcctgcttgcatcaagtgggcttgtggtgctgtacatcacaattaatgtcattaagttgta

SEQ ID NO: 7019 - DNA, 304 bp, Zea mays
  Clone ID: 700075221H1
gttgtgatcttcctcttccttggttcggttgagggattcagcacgaagagccagccctgcacatatagcaaggacaagtactgcaagcctgcgctgttcactgcactctttagcactgtgtccttcttgcttggagccatcacctctctggtctctggtttccttggcatgaagattgccacatatgcgaatgccagaactaccctggaagctaggaagggtgttggcaaggcttttatcactgctttccgctctggcgctgttatgggtttcctgcttgcatcaagtgggcttgtggttctgt

SEQ ID NO: 7020 - DNA, 301 bp, Zea mays
  Clone ID: 700213731H1
gaacgccatctccgaagagcaacatcgtttcttttcaccgagtaccaatatgttggtatcttcatggctatcttcgctgttgtgatcttcctcttccttggttcggttgagggattcagcacgaagagccagccctgcacatatagcaaggacaagtactgcaagcctgcgctgttcactgcactctttagcactgtgtccttcttgcttggagccatcacctctctggtctctggtttccttggcatgaagattgccacatatgcgaatgccagaactaccctggaagctaggaagggtg

SEQ ID NO: 7021 - DNA, 273 bp, Zea mays
  Clone ID: 700215864H1
gtgtccttcttgcttggagccatcacctctctggtctctggtttccttggcatgaagattgccacatatgcgaatgccagaactaccctggaagctaggaagggtgttggcaaggcttttatcactgctttccgctctggcgctgttatgggtttcctgcttgcatcaagtgggcttgtggttctgtacatcacaattaatgtatttaagttgtattacggtgatgactgggagggtctttttgagtccatcactggctatggtcttggtggg

SEQ ID NO: 7022 - DNA, 270 bp, Zea mays
  Clone ID: 700465076H1
ctgagtaccaatatgttggtatcttcatgtccatctttgctgttgtgatcttcctcttccttggttcggttgagggattcagcacgaagagccagccctgcacctatagcaaggacaagtactgcaagcctgcactgttcactgcactctttagcactgtgtccttcttgcttggagccatcacctctctggtctccggtttccttggcatgaagattgccacatatgcgaatgccagaactaccctggaagctaggaagggtgttggca

SEQ ID NO: 7023 - DNA, 274 bp, Zea mays
  Clone ID: 700077092H1
gggattcagcacgaatagccagccctgcacatatagcaaggacaagtactgcaagcctgcgctgttcactgcactctttagcagtgtgtccttcttgcttggagccatcagctctctggtctctggtttcgttggcatgaagattgccacatatgcgagtgccagaactaccctggaagctacgaagggtgttggcaaggcttttatcactgctttccgctctggcgctgttatgggtttcctgcttgcatcaagtgggcatgtggttctgtac

SEQ ID NO: 7024 - DNA, 376 bp, Zea mays
  unsure (1)...(376): unsure at all n locations
  Clone ID: 700204306H1
gctctcncctcaccgcctccaggagatccgccgcttcttcgaagactacaagaagaacgagaacaaggaggtggccgtcaacgacttcctgcccgccgccgctgcccgcgaaccatccagtactccatggacctgtacggccagtacatcatgcagaccctgcggcggtagagcgtgtcctaccagatcccatgcgagctgagctgacgcaagagcacagatcgacagaatccttgtggtctcgtctcatgcatggatagccaggtcacatggcttgtcgacgaccatgcatctcttcttcccagcgattttagcctgtatcttcccttatttatagtcttttggggttggtggaatctgtccacagtgtggtttg

SEQ ID NO: 7025 - DNA, 273 bp, Zea mays
  Clone ID: 700451634H1
cttcaactttggtgtgcagaagacggtgtataactggcaattattcctatgcgtggcagttggtctgtgggcaggactagttattggatttgttacggagtattacacaagcaatgcatacagtcctgtacaggatgttgctgattcctgcagaactggagctgctacgaatgtcatctttggccttgctctgggatataaatccgtcattatccctatttttgctattgcttttagtatttttctcagcttcagccttgctgccatgtacgg

SEQ ID NO: 7026 - DNA, 268 bp, Zea mays
  Clone ID: 700166756H1
cccacgcgtccggcaggaacaagttgtccctgggtgttttctgcgagctcgtgctattgggctcatgcctatgatcgatcagggtgagaaagatgataagatcatagctgtctgtgctgatgaccctgaattccgtcactacaaggacatctcggacctccccccgcatcgccttcaagagatccgccgcttttttgaagattataaaaagaatgaaaacaaagaagttgcagtgaatgatttcctcccagccgaagatgccatcaaa

SEQ ID NO: 7027 - DNA, 248 bp, Zea mays
  Clone ID: 700042535H1
agatgataagattatagcagtctgtgctgatgaccctgaattccgtcactacacggacatcacggacctcccaccgcatcgccttcaagagatccgccgcttttttgaagattataaaaagaacgaaaacaaggaggtcgcagtgaatgagttcctgccagcgaaagatgccatcaacgcaatcaagtactcgatggacctgtatggctcatacgtcatcgaaagcctgaggaagtgatctccagctg

SEQ ID NO: 7028 - DNA, 250 bp, Zea mays
  Clone ID: 700242009H1
cttgtttctggtgtccagattgccatctctgcatccaacactggaggtgcctgggacaacgcaaagaaatacattgaggctggtgcatctgagcatgcaagaaccttgggcccgaaaggttcagacccacacaaggctgctgtcattggtgacaccatcggtgatcccctcaaggacacctcaggcccctcgctgaacatcctcatcaagctcatggctgtcgagtcccttgtctttgctcccttcttcg

SEQ ID NO: 7029 - DNA, 341 bp, Zea mays
  Clone ID: 700624035H1
ataacttcttgccatgctgcatgtttcattctaatctatattgtttctattcagattgccatctctgcatccaacactggaggtgcctgggacaacgcaaagagatacattgaggctggtgcatctgagcatgcaagaaccttgggcccgaaaggttcagacccacacaaggctgctgtcatcggtgacaccatcggtgatcccctcaaggacacctcaggcccctcgctgaacatcctcatcaagctcatggctgtcgagtcccttgtctttgctcccttcttcgccacccatggaggcatcctcttcaaatggctttagaggaagaatggaagatggat

SEQ ID NO: 7030 - DNA, 313 bp, Zea mays
  Clone ID: 700266136H1
agacaacgcaaagaaatacattgaggctggtgcatctgagcatgcaagaaccttgggcccgaaaggttcagacccacacaaggctgctgtcatcggtgacaccatcggtgatcccctcaaggacacctcaggcccctcgctgaacatcctcatcaagctcatggctgtcgagtcccttgtctttgctcccttcttcgccacccatggaggcatcctcttcaaatggctttagaggaagaatggaagatggatgggtagtttatttttgccgggggagagcactagatatatgtcatagagaagtttcagttta

SEQ ID NO: 7031 - DNA, 288 bp, Zea mays
  Clone ID: 700220713H1
ttgacactctttttcaacatatatgactgttttcattgttataacctcttgccatgctgcatgtttcattcataatctatattgtttctattcagattgccatctctgcatccaacactggaggtgcctgggacaacgcaaagaaatacattgaggctggtgcatctgagcatgcaagaaccttgggcccgaaaggttcagacccacacaaggctgctgtcattggtgacaccatcggtgataccctcaaggacacctcaggcccctcgctgaacatcctcatcaagc

SEQ ID NO: 7032 - DNA, 274 bp, Zea mays
  Clone ID: 700237775H1
gagataccaaggggcagcaaggttaaatatgaacttgacaagaaaactggactgatcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatg

SEQ ID NO: 7033 - DNA, 292 bp, Zea mays
  Clone ID: 700342456H1
caaggttaaatatgaacttgacaagaaaactggactgatcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatatcaaggag

SEQ ID NO: 7034 - DNA, 321 bp, Zea mays
  Clone ID: 700073654H1
ggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagctaggttaaatatgaacttgacaagaaaactggactgatcaaggtggaccgtgtgctgtattcatcagttgtttaccctcacaactatggattcattcctcgcacgctttgtgaagacagtgatcctttggatgtactggt

SEQ ID NO: 7035 - DNA, 276 bp, Zea mays
  Clone ID: 700577805H1
cacacccttggcatgatctggagataggtcctggtgctccaaccatattcaactgcgtcattgagataccaaggggcagcaaggttaaatatgaacttgacaagaaaactggactgatcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggcc

SEQ ID NO: 7036 - DNA, 272 bp, Zea mays
  Clone ID: 700028881H1
ctggactgatcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatatcaaggagctcccacct

SEQ ID NO: 7037 - DNA, 270 bp, Zea mays
  unsure (1)...(270): unsure at all n locations
  Clone ID: 700215076H1
gatgtactggttataatgcaggngcctgttatcccaggctgtttcctacgtgcgaaggccatcggccttatgccgatgattgatcagggagaggcagatgacaagatcattgcagtgtgcgctgatgatcccgagtacaggcattacaatgatatcaaggagctcccacctcaccgcttggctgaaatcaggcgcttcttcgaggactacaagaagaatgagaacaaggaggttgctgtgaatgactttctaccagcgagcgccgcttat

SEQ ID NO: 7038 - DNA, 245 bp, Zea mays
  Clone ID: 700017479H1
gcacgagattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatatcaaggagctcccacctcaccgcttggctgaaatcaggcgcttc

SEQ ID NO: 7039 - DNA, 306 bp, Zea mays
  Clone ID: 700204495H1
ccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatatcaaggagctcccacctcaccgcttggctgaaatcaggcgcttcttcgaggactacaagaagaatgagaa

SEQ ID NO: 7040 - DNA, 192 bp, Zea mays
  Clone ID: 700196795H1
gcatgatctggagataggtcctggtgctccaaccatattcaactgcgtcattgagataccaaggggcagcaaggttaaatatgaacttgacaagaaaactggactgatcaaggtggaccgtgtgctgtattcatcagttgtttaccctcacaactatggattcattcctcgcacgctttgtgaagacagtga

SEQ ID NO: 7041 - DNA, 244 bp, Zea mays
  Clone ID: 700018612H1
cgccgctgacccaggttgtcttgatggcgcccgctgtagaagccgtgaaggagacaggcaccttccagaaggttcctgccttgaacgaaaggatactgtcagccatgtccaggaggtctgttgctgcacacccttggcatgatctggagataggtcctggtgctccaaccatattcaactgcgtcattgagataccaaggggctactaggttaaatatgaacttgacaagaaaactggactgat

SEQ ID NO: 7042 - DNA, 311 bp, Zea mays
  Clone ID: 700102142H1
cggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaaactggactg

SEQ ID NO: 7043 - DNA, 301 bp, Zea mays
  Clone ID: 700348430H1
agctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaa

SEQ ID NO: 7044 - DNA, 249 bp, Zea mays
  Clone ID: 700439515H1
ccagatttggccgccgccgccgctgacccaggttgtcttgatggcgcccgctgtagaagccgtgaaggagacaggcaccttccagaaggttcctgccttgaacgataggatactgtcatccatgtccaggaggtctgttgctgcacacccttggcatgatctggagataggtcctggtgctccaaccatattcaactgcgtcattgagataccaggggcagcaaggttagatatgaacttgacaagaaa

SEQ ID NO: 7045 - DNA, 312 bp, Zea mays
  Clone ID: 700074977H1
ctgacgcgtgggcggacgcgtgggcggctccgtcgtcgcgtgccatcctagggtttctttccccgtcggcgcctccccagatttggccgccgccgccgctgacgcaggttgtcctatatggcgcccgctgtagaagccgtgaaggagacaggcaccttccagaaggttcctgccttgaacgaaaggatactgtcatccatgtccaggaggtctgttgctgcacacccttggcatggtctggagataggtcctggtgctccaaccatattcaactgcgtcattgagataccaaggggcagcaaggttaaatat

SEQ ID NO: 7046 - DNA, 276 bp, Zea mays
  Clone ID: 700023120H1
gtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaata

SEQ ID NO: 7047 - DNA, 359 bp, Zea mays
  unsure (1)...(359): unsure at all n locations
  Clone ID: 700615213H1
aggaaatagaaagtctccctggactctaaaatcaatgcctgtgaacacatgaactgtttgtgtcacccatgttcctctgctccttggcactttctgatggatgctcaaatgcttaagaaagactcatagaagcgactcctattcctatgccaggtcattgagataccaaggggcagcaaggttaaatatggacttgcaagaaaactggactgatcaaggtggaccgtgtgctgtattcatcagttgtttaccctcacaactatggattcattcctcgcacgctttgtgaagacagtgatcctttggatgtactggttataatgcangagcctgttatcccaggctgtttcctacgtgcg

SEQ ID NO: 7048 - DNA, 293 bp, Zea mays
  Clone ID: 700074109H1
gactagttctagatcccggctccgtcgtcgtcgtgccatcctagggtttctttccccgtcggcgcctccccagatttggccgccgccgccgctgacccaggttgtcttgatggcgcccggctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagc

SEQ ID NO: 7049 - DNA, 268 bp, Zea mays
  Clone ID: 700026094H1
ggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaagg

SEQ ID NO: 7050 - DNA, 290 bp, Zea mays
  Clone ID: 700549517H1
actagttctagatcccggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagc

SEQ ID NO: 7051 - DNA, 277 bp, Zea mays
  Clone ID: 700030347H1
cggctcgagggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtaaggccaccctgtcat

SEQ ID NO: 7052 - DNA, 265 bp, Zea mays
  Clone ID: 700221176H1
cggacgctgggcggctccgtcgtcgcgtgccatcctagggtttctttccccgtcggcgcctccccagattacgccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtc

SEQ ID NO: 7053 - DNA, 183 bp, Zea mays
  Clone ID: 700433360H1
gctgaaatcaggcgcttctacgaggactacaagaagaatgagaacaaggaggttgctgtgaatgactttctaccagcgagcgccgctatgaagccatacagcactctatggacctgtatgctacatacatcgttgagggcctgaggaggtaggattctgatggctaggaaaggtggggaggat

SEQ ID NO: 7054 - DNA, 304 bp, Zea mays
  Clone ID: 700047790H1
gtctcacacacggccgccgcccttgccttcgtgcgttccccgcgtagagtttagggttttgtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgtccggcggcagccagaacggctacggcgactacctcatcgacgaggaggaggggctcaacgaccacaacgtcgtcgtcaagtgcgccgagatccagaccgctatctccg

SEQ ID NO: 7055 - DNA, 304 bp, Zea mays
  Clone ID: 700266224H1
cgcgtctcccacacggccgccgccctcgccttcgtgcgttccccgcgtagagtttagggttttgtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgtccggcggcagcaagaacggctacggcgactacctcatcgaggaggaggaggggctcaacgaccacaacgtcgtcgtcaagtgcgccgagatccagaccgctatct

SEQ ID NO: 7056 - DNA, 283 bp, Zea mays
  Clone ID: 700209335H1
gactagttctagagcgtgacgcgtctcccacacggccgccgccctcgccttcgtgcgttccccgcgtagagtttagggttttgtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgtccggcggcagcaagaacggctacggcgactacctcatcgaggaggaggaggggctcaacgaccac

SEQ ID NO: 7057 - DNA, 286 bp, Zea mays
  Clone ID: 700089769H1
gtgacgcgtctcccacacggccgccgcccttgccttcgtgcgttccccgcgtagagtttagggttttgtcgccgccatggcgatcctctcggcgctcgccaccgaagtgttcatccccgtcgccgccgtcatcggcatcgccttcgccgtcgtgcagtgggtgctcgtgtcgcgggtgaagctctccccggctgcagccgcgtccggcggcagcaagaacggctacggcgactacctcatcgatgaggaggaggggctcaacgaccacaacgtcgtcgtcaagtgc

SEQ ID NO: 7058 - DNA, 248 bp, Zea mays
  Clone ID: 700151762H1
gcgtgacgcgtctcccacacggccgccgccctcgccttcgtgcgttccccgcgtagagtttagggttttgtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgtccggcggcagcaagaacggctacggcgactacctcatcgagga

SEQ ID NO: 7059 - DNA, 160 bp, Zea mays
  Clone ID: 700449259H1
gccgcgtctcccacacggccgccgtccttgccttcatgcgttccccgcgtagagtttagggttttgtcgccgccatggcgatcctctcggcgctcgtcaccgaggtgttcatccccgtcgccgccgtcatcggcatcgccttcgccgtcgtgcagtgggt

SEQ ID NO: 7060 - DNA, 291 bp, Zea mays
  unsure (1)...(291): unsure at all n locations
  Clone ID: 700026151H1
caatgattgatgagggagagcttgactggaaaattgtggccatttctttggatgacccgaaagcatctcttgtgaacgacgtggatgatgttgagaagcattttccggggacactgactgccatcagagactggttcagagactacaagatacctgatggaaagcctgccaacaaatttggtctcggcaacaagcccgcaagcaaggaatacgccctgaaggtcattcaagagaccaacgaatcatgggagaaattggtanagagaaatattcccgctggagagctctcgt

SEQ ID NO: 7061 - DNA, 281 bp, Zea mays
  Clone ID: 700347165H1
ccgaaagcatctcttgtgaacgacgtggatgatgttgagaagcattttccggggacactgactgccatcagagactggttcagagactacaagatacctgatggaaagcctgccaacaaatttggtctcggcaacaagcccgcaagcaaggaatacgccctgaaggtcattcaagagaccaacgaatcatgggagaaattggtaaagagaaatattcccgctggagagctctcgttggcctgattttggcccatggaagccaccacattcttttgaactgc

SEQ ID NO: 7062 - DNA, 269 bp, Zea mays
  Clone ID: 700430341H1
tgttgagaagcattttccggggacactgactgccatcagagactggttcagagactacaagatacctgatggaaagcctgccaacaaatttggtctcggcaacaagcccgcaagcaaggaatacgccctgaaggtcattcaagagaccaacgaatcatgggagaaattggtaaagagaaatattcccgctggagagctctcgttggcctgattttggcccatggaagccaccacattcttttgaactgctttcgtgagcatgtcgtttt

SEQ ID NO: 7063 - DNA, 257 bp, Zea mays
  Clone ID: 700457781H1
gacccaacttctgcaaattctgaggttgaaggagcgtttggggataatgatcctgttgatgttgttgagatcggtgaaagacgtgccaatgtcggggatgttcttaaggttaagccattggcagctttagcaatgattgatgagggagcagcttgactggaaaattgtggccatttctttggatgacccgaaagcatctcttgtgaacgacgtagatgatgttcaacagcttttccggggacactactgccatcaga

SEQ ID NO: 7064 - DNA, 325 bp, Zea mays
  Clone ID: 700104993H1
gtttgccgatcgagcccgggcgacgtgagatacgagcggcgtcgaccggcgccggcgagcctccgcagccgcagccgcccgatctgggttttctttcgtagcggtagcgcaagatgagccaggaccaggagaacggaggcaccaacgggcagcacgccgccgacgtcatggaggtggagccgaagcgccgggcgccgcggctgaacgagcgcatcctgtcgtcgctgtcgcggaggtccgtcgccgcgcacccctggcacgacctcgagatcggtcctgaagctccggccgtcttcaacgtcgtcgtggagatcaccaaggggag

SEQ ID NO: 7065 - DNA, 227 bp, Zea mays
  unsure (1)...(227): unsure at all n locations
  Clone ID: 700203452H1
cgtagtntagcggaagatgagccaggaccaggagaacggaggcaccaacgggcagcacgccgccgacgtgatggaggtggagccgaagcgccgggcgccgcggctgaacgagcgcatcctgtcgtcgctgtcgcggaggtccgtcgccgcgcacccctggcacgacctcgagatcggtcctgaagctccggccgtcttcaacgtcgtcgtggagatcaccaagggga

SEQ ID NO: 7066 - DNA, 286 bp, Zea mays
  Clone ID: 700105585H1
agcgtttactcctaactagtttgccgatcgagcccgggcgacgtgagacacgagcggcgtcgaccggcgccggcgagcctccgcagccgcagccgcccgatctgggttttctttcgtagcggtagcgtaagatgagccaggaccaggagaacggaggcaccaacgggcagcacgccgccgacgtgatggaggtagagccgaagcgccgggcgccgcggctgaacgagcgcatcctgtcgtcgctgtcgcggaggtccgtcgccgcgcacccctggcacgacctcga

SEQ ID NO: 7067 - DNA, 274 bp, Zea mays
  Clone ID: 700240805H1
agcgtttactcctaactagtttgccgatcgagccccggcgacgtgagatacgagcggcgtcgaccggcgccggcgagcctccgcagccgcagccgcccgatctgggttttctttcgtagcggtagcggaagatgagccaggaccaggagaacggaggcaccaacgggcagcacgccgccgacgtgatggaggtggagccgaagcgccgggcgccgcggctgaacgagcgcatcctgtcgtcgctgtcgcggaggtccgtcgccgcgcacccctg

SEQ ID NO: 7068 - DNA, 275 bp, Zea mays
  Clone ID: 700030336H1
cagcgtttactcctaactagtttgccgatcgagcccgggcgacgtgagatacgagcggcgtcgaccggcgccggcgagcctccgcagccgcagccgcccgatctgggttttctttcgtagcggtagcggaagatgagccaggaccaggagaacggaggtaccaacgggcagcacgccgccgacgtgatggaggtggagccgaagcgccgggcgccgcggctgaacgagcgcatcctgtcgtcgctgtcgcggaggtccgtcgccgcgcacccctg

SEQ ID NO: 7069 - DNA, 273 bp, Zea mays
  Clone ID: 700217859H1
agcgtttactcctaactagtttgccgatcgagcccgggcgacgtgagatacgagcggcgtcgaccggcgccggcgagcctccgcagccgcagccgcccgatctgggttttctttcgtagcggtagcggaagatgagccaggaccaggagaacggaggcaccaacgggcagcacgccgccgacgtgatggaggtggagccgaagcgccgggcgccgcggctgaacgagcgcatcctgtcgtcgctgtcgcggaggtccgtcgccgcgcacccct

SEQ ID NO: 7070 - DNA, 295 bp, Zea mays
  Clone ID: 700473069H1
aaggcttttatcaccgcttttcgctctggtgctgttatgggctttctgcttgcatcaagtgggcttgtggttctgtacatcaccattaatgtatttaagttgtattacggtgatgactgggagggtctttttgagtctatcactggctatggccttgtcgggtcgtccatggctctctttggaagagttggtggaggcatctacacaaaggctgctgacgttggtgctgatcttgttggaaaggtcgagaggaacattcctgaggatgatcctaggaacccagctgtgattgctg

SEQ ID NO: 7071 - DNA, 271 bp, Zea mays
  Clone ID: 700151232H1
gtgatgactgggagggtctttttgagtctatcactggctatggccttggtgggtcgtccatggctctctttggaagagttggtggaggcatctacacaaaggctgctgacgttggtgctgatcttgttggaaaggtcgagaggaacattcctgaggatgatcctaggaacccagctgtgattgctgataatgtcggtgacaatgttggtgacattgctggaatgggatctgatctctttgggtcatatgcagagtcttcctgtgctgccct

SEQ ID NO: 7072 - DNA, 301 bp, Zea mays
  Clone ID: 700103088H1
ccgcagcgtgggcgcgacgcgtgggccacaactaccctggaagctaggacgggtgttggcaaggcctttatcactgctttccgctctggcgctgttatgggtttcctgctcgcatcaagtcggcttgtggttctgtacatcacaattaatgtatttaagttgtattacggtgatgactgggagggtctttttgagtccatcactggctatggtcttggtgggtcgtccatggctctcttcggaagacttggtggaggtatctacacaaaggctgctgatgttggtgccgatcttgttggaa

SEQ ID NO: 7073 - DNA, 273 bp, Zea mays
  Clone ID: 700450086H2
gcttgcatcaagtgggcttgtggttctgtacatcaccattaatgtatttaagttgtattacggtgatgactgggagggtctttttgagtctatcactggctatggccttggtgggtcgtccatggctctctttggaaggttggtggaggcatctacacaaaggctgctgacgttggtgctgatcttgttggaaaggtcgagaggaacattcctgaggatgatcctaggaacccagctgtgattgctgataatgtcggtgacaatgttggtgac

SEQ ID NO: 7074 - DNA, 255 bp, Zea mays
  Clone ID: 700458843H1
ctcgagccgaatcggctcgaggggagggtctttttgagtctatacctggctatggccttagtgggtcgtccatggctctctttggaagagttggtggaggcatctacacaaaggctgctgacgttggtgctgatcttgttggaaaggtcgagaggaacattcctgaggatgatcctaggaacccagctgtgattgctgataatgtcggtgacaatgttggtgacattgctggaatgggatctgatctctttgggt

SEQ ID NO: 7075 - DNA, 234 bp, Zea mays
  Clone ID: 700165715H1
cccacgcgtccgggcgctgttatgggtttcctgcttgcatcaagtgggcttgtggttctgtacatcacaattaatgtatttaagttgtattacggtgatgactgggagggtctttttgagtccatcactggctatggtcttggtgggtcgtccatggctctcttcggaagagttggtggaggtatctacacaaaggctgctgatgttggtgccgatcttgttggaaaggtcgag

SEQ ID NO: 7076 - DNA, 156 bp, Zea mays
  Clone ID: 700352887H1
atgactgggagggactttttgagtccatcactggctatggtcggggtgggtcgtccatggctctcttcggaagagttggtggaggtatcaacacaaaggctgctgatgttggtgccgatcttgttggaaaggtcgagaggaacattcctgaggatg

SEQ ID NO: 7077 - DNA, 324 bp, Zea mays
  Clone ID: 700206525H1
tgactgttggtattgctgtaatcagctggttggcccttccagctaagtttaccatcttcaactttggtactcagaaggatgtctccaactggggcttgttcttctgtgttgcaattggtctgtgggctggtctgattattggttttgtcacagaatactacactagcaatgcatacagtcctgtgcaagacgttgcagattcttgcagaactggtgctgccactaatgtcatttttggtcttgctcttggatacaagtcagttatcatcccgattttcgctatcgctgttagcatctatgtcagtttctccattgctgcaatgt

SEQ ID NO: 7078 - DNA, 306 bp, Zea mays
  Clone ID: 700096774H1
gttggaaaggtcgagaggaacattcctgaggatgatcctaggaacccagctgtgattgctgataatgtcggtgacaatgttggtgacattgctggaatgggatctgatctctttgggtcatacgcagagtcttcttgtgctgcccttgttgttgcgtctatttcatctttcggaatcgaccatgatttcactgggatgtgctacccactccttgttagctctgttggtatcattgtctgcttgatcaccaccctttttgctactgatttctttgaagtcaaggctgtgaaagaaattgagcctgca

SEQ ID NO: 7079 - DNA, 297 bp, Zea mays
  Clone ID: 700466734H1
ctgggatgtgctacccactccttgttagctctgttggtatcattgtctgcttgatcaccaccctttttgctactgatttctttgaagtcaaggctgtgaaagaaattgagcctgcacttaagaagcagctcatcatctccaccgccctactgactgttggtattgctgtaatcagctggttggcccttccagctaagttcaccatcttcaactttggtactcagaaggatgtctccaactggggcttgttcttctgtgttgcaattggtctgtgggctggtctgattattggttttg

SEQ ID NO: 7080 - DNA, 288 bp, Zea mays
  Clone ID: 700332548H1
gaggtttccaactggggtttgttcttctgtgtttcaattggtctgtgggctggtttgattattggttttgtcacagaatactacactagcaatgcatacagtcctgtgcaagatgttgcggattcgtgcagaactggtgctgccactaatgtcatttttggtcttgctcttggatacaagtctgttatcatcccgattttcgctattgctgttagcatctatgtcagtttctccattgctgcgatgtacggcattgcagttgccgctcttggtatgctgagcacaatc

SEQ ID NO: 7081 - DNA, 272 bp, Zea mays
  Clone ID: 700085122H1
caactggggcttgttcttctgtgttgcaattggtctgtgggctggtctgattattggttttgtcacagaatactacactagcaatgcatacagtcctgtgcaagacgttgcagattcttgcagaactggtgctgccactaatgtcatttttggtcttgctcttggatacaagtcagttatcatcccgattttcgctatcgctgttagcatctatgtcagtttctccattgctgcaatgtacggcatcgcagttgccgctcttggtatgctga

SEQ ID NO: 7082 - DNA, 291 bp, Zea mays
  Clone ID: 700207180H1
atttcatctttcggaatcgaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccaccgtcctgatgacttttggtattgctctaatcagctggttggcccttccagctaagttcaccatctacaacttcggtactcagaaggaggtttccaactggggtttgttcttctgtgtt

SEQ ID NO: 7083 - DNA, 282 bp, Zea mays
  Clone ID: 700333910H1
gctggttggcccttccagctaagttcaccatcttcaactttggtactcagaaggatgtctccaactggggcttgttcttctgtgttgcaattggcctgtgggctggtctgattattggttttgtcacagaatactacactagcaatgcatacagtcctgtgcaagacgttgcagattcctgcagaactggtgctgccactaatgtcatttttggtcttgctcttggatacaagtcagttatcatcgcgattttcgctatcgctgttagcatctatgtcagtt

SEQ ID NO: 7084 - DNA, 264 bp, Zea mays
  Clone ID: 700223824H1
ttcaactttggtactcagaaggatgtctccaactggggcttgttcttctgtgttgcaattggcctgtgggctggtctgattattggttttgtcacagaatactacactagcaatgcatacagtcctgtgcaagacgttgcagattcctgcagaactggtgctgccactaatgtcatttttggtcttgctcttggatacaagtcagttatcatcccgattttcgctatcgctgttagcatctatgtcagtttctccattgctgca

SEQ ID NO: 7085 - DNA, 278 bp, Zea mays
  Clone ID: 700222034H1
cgcagagtcttcttgtgctgcccttgttgttgcgtctatttcatctttcggaatcgaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccaccgtcctgatgacttttggtattgctctaatcagctggttggcgcttccagctaagttcaccatctaca

SEQ ID NO: 7086 - DNA, 329 bp, Zea mays
  unsure (1)...(329): unsure at all n locations
  Clone ID: 700570554H1
cgcagagtcttcttgtgctgcccttgttcgtaccgtctatttcatctttcggaatcgaccatgatttcactgggatgtgctacccactccttgttagctctgttggtatcattgtctgcttgatcaccaccctttttgctactgatttctttgaagtcaaggctgtgaaagaaattgagcctgcacttaagaagttgctcatcatctccaccgtcctgatgacttttggtattgctctaatcagctggtggcccttccagctaagttcaccatctacaacttcggtactcagaaggaggtttccaactgnggtttgttcttctgtgttt

SEQ ID NO: 7087 - DNA, 277 bp, Zea mays
  Clone ID: 700241783H1
aaagaaattgagcctgcacttaagaagcagctcatcatctccaccgtcctgatgacttttggtattgctctaatcagctggttggcccttccagctaagttcaccatctacaacttcggtactcagaaggaggtttccaactggggtttgttcttctgtgtttcaattggtctgtgggctggtttgattattggttttgtcacagaatactacactagcaatgcatacagtcctgtgcaagatgttgcggattcgtgcagaactggtgctgccacta

SEQ ID NO: 7088 - DNA, 288 bp, Zea mays
  Clone ID: 700224305H1
catgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccaccgtcctgatgacttttggtattgctctaatcagctggttggcgcttctagctaagttcagcatctacaacttcggtactcagaatgaagtttccaactggggtttgatcttttgtgattcaattgggctgtgggcc

SEQ ID NO: 7089 - DNA, 271 bp, Zea mays
  Clone ID: 700458382H1
agaaccagctgtgattgctgataatgtcggtgacaatgttggtgacattgctggaatgggatctgatctctttgggtcatatgcagagtcttcctgtgctgcccttgttgttgcgtctatttcatctttcggaatcaaccatgatttcactgggatgtgctacccactccttgttagctctgttggtatcattgtctgcttgatcaccaccctttttgctactgatttctttgaagtcaaggctgtgaaagaaattgagcctgcacttaag

SEQ ID NO: 7090 - DNA, 169 bp, Zea mays
  Clone ID: 700151266H1
gtctgattattggttttgtcacagaatactacactagcaatgcatacagtcctgtgcaagacgttgcagattcttgcagaactggtgctgccactaatgtcatttttggtcttgctcaaggatacaactcactcatcatcccgattttcgctatcgctgttagcatcta

SEQ ID NO: 7091 - DNA, 268 bp, Zea mays
  unsure (1)...(268): unsure at all n locations
  Clone ID: 700470565H1
gagcaataccaaaagtcatcagaaggaggtttccaactggggtttgttctnctgtgtnncaattggtctgtgggctggtttgattattggttttgtcacagaatactacactagcaatgcatacagtcctgcaagatgtgcggattcgtgcagaactggtgctgccactaatgtcacttttggtcttgctcttggatacaagtctgttatcatcccgattttcgctattgctgttagcatctatgtcagtttctccattgctgcgatg

SEQ ID NO: 7092 - DNA, 237 bp, Zea mays
  Clone ID: 700207802H1
atctgatctctttgggtcatacgcagagtcttcttgtgctgcccttgttgttgcgtctatttcatctttcggaatcgaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccaccgtctg

SEQ ID NO: 7093 - DNA, 294 bp, Zea mays
  Clone ID: 700049926H1
cgaggacctcggtccaagggatccgactgccacaaggccgctgtgatcggtgacaccattggtgaccccctgaaggacacctccggcccgtccctcaacatcctcatcaagctcatggccgtggagtccctcgtgtttgcccccttctttgccacccagggtggcctgctcttcaagtacctgtaaaagggacaacaccaagcacacagcagaagtatacgatctcccgaccgaccgtggacaatatcgaataactcctgccaaatcgccagttccttttgtgtactgtgcgct

SEQ ID NO: 7094 - DNA, 268 bp, Zea mays
  Clone ID: 700458612H1
gtgccagcgagcacgcgaggaacctcggtcccaagggatccgactgccacaaggccgctgtgatcggtgacaccattggtgaccacgtgaaggacacctccggcccgtccctcaacatcctcatcaagctcatggagatggagtccctcgtgtttgcccccttctttgccacccagggtggcctgctcttcaagtacctgtaaaagggacaacaccaagcacacagcagaagtatacgatctcccgaccgaccgtggacaatatcgaa

SEQ ID NO: 7095 - DNA, 462 bp, Zea mays
  unsure (1)...(462): unsure at all n locations
  Clone ID: LIB143-006-Q1-E1-C9
agttgtgtatgtcacggtctgatgcgcgccactctcacatgcctncgcctgtcaggcagcgccaccggctctgtttcgtcatggttatgacaaaagtggatgcagttctccgttgccgattctcggaatcggtttctcgattgatgcctgaaatttcatcatgattagcgtttatgggtgatttcaacgatgagggggttcccaagggctatgctttccctctcacgatgcctactgttactctgattgagtgaagatttgcaaccttcactcacaggtcagctgctgcacatccgtggcatttcgtgtagattgttccataagcgcctactgttttcaactgtgtagttgtcattatcaagagtagtacggttaagtatgagctacacacagacagtagacttaattgggctgatcacgttctctattcaaccattatttacccccaaagctacggtttca

SEQ ID NO: 7096 - DNA, 408 bp, Zea mays
  Clone ID: LIB143-026-Q1-E1-C3
gggtggcgtacttcacgtcgcggtgcggtctacaattagagtcgagcacgcgtccgatcatagtccgtgtacgcgtccaatgacgtctcttgcacagcgcaccataactcagcatttactgaacatggactgcagctcccctcggaggcgtcctcgctggcatgagcgggagaggagctactggtactacatctaatagcatggactggtctggtgaatgtggaccgtctgctttaatcatcaattatttaagctcataactatggattcattcctcacacgctttgtgaacacagtgatcctttggatgtactggttataatgcaggagcctgttatcccaggctgtttcctatgtgcgattgcaatcggccttatcccgaatattgatcagggagaagcagatgac

SEQ ID NO: 7097 - DNA, 424 bp, Zea mays
  Clone ID: LIB148-009-Q1-E1-D8
agcgtcaccgtcctggtgatcacgcccagatcaaatcctattcaaatttggagcgcaatatggctgaagagaagagccgtccgcggctgaacgagcggatcatgtcgtccctctcaaagcggtcggtcgctgcgcattcctggcatgaccttgagataggacctggagcccctgctgttttcaattgtgttgttgagatcacaaagggcagtaaagtgaaatatgagctagacaagaagaccggaatgatcaaggttgacagggtgctatactcatcagtggtctacccacacaactacggtttcattccacgaacattgtgtgaagacggagatccaatggatgtgctggtgttgatgcaggaaccggtgatacctggctgttttcttcgggcaagggccatcggccttatgcccatgattga

SEQ ID NO: 7098 - DNA, 390 bp, Zea mays
  Clone ID: LIB3059-029-Q1-K1-A12
cccacgcgttcgcccacgcgttcgcggacgcgtgggtgattattggttttgtcacataatacgacactagcaatgcatacagtcttgtgcaagacgttgcagattcctgcagaactggtgctgccactaatgtcattttgggtcttgctcttggatacaatgacaatgctggtggtattgctgagaactgatgctgttgatgctgctggcaacaccactgccgctattggaaagggatttgccattggttcagctgctcttgtgtctctggcgcttttttggtgcctttgtcagcagagctggagtcaaggttgtccatgtactcttccccaaggttttcattggtttgattgttggagccatgcttgcctattggatctatggcatgac

SEQ ID NO: 7099 - DNA, 292 bp, Zea mays
  Clone ID: LIB3059-031-Q1-K1-C7
aggttcagccttgctgccatgtacggttttgctgtggctgctcttggaatgctcaagacaagcgctactggcctggccattgatgcctatggtcctatcagtgacaatgctggaggaattgctgaaatggctggcatgagccacagaatccgtgagagaactgatgctcttgatgctgctggaaatactactgctgccattgggaagggttttgcaataggttcagcagccttggtgtctcttgccctctttggtgcttttgtcacccgtgctgaaatctctactgttgaag

SEQ ID NO: 7100 - DNA, 472 bp, Zea mays
  unsure (1)...(472): unsure at all n locations
  Clone ID: LIB3067-042-Q1-K1-H8
agaaatggtgtnnncctaaatctcagcctgatnctttaccactccctccggnatccgggcaagcgccggatccacgcgtcccgtgactcgtggtcggtgccccgttgcgtctctgtaaaaccagacggcgaaccactgctgcggtccactgcatcccgggtccgtcttctcgtgccatgctacggttgctttctcccgtcggcgcctgcgcagatttggccgccgtcgccgctgacccaggctgtcttgatggcgcccgatgcagaagccgctaaggggacaggcaccgttccacaaaggtgctctgccattgaacgaaaggatactggcatgcatgtccaggaggtctgctgctggacacccttggcatgatctggagataggccctggagctccaaccatattcaactgcgtcattgagatacccaggggcagcaaggtttaatatgaacttgacaaggaaactggactg

SEQ ID NO: 7101 - DNA, 412 bp, Zea mays
  Clone ID: LIB3067-035-Q1-K1-H12
gtaccgtatcagtctcccggattctctccggttcgtgggagggccaaagcttcgagttaggaaaaccgtaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcccgtgatcgcgtcgggggtgtggttcgcgtcggcgcagggcgaggagtgcgcgcgcctggcgcggtggcccgtggccatcctgggcgggctgctcctgctggccgcgctggcgggcttcgtgggcgcgtactggaaccggcgcggcctgctggccttctacctcttcgccatggcgtcgctcgtggtgctcctcatcgcgctcctc

SEQ ID NO: 7102 - DNA, 164 bp, Zea mays
  Clone ID: LIB3078-029-Q1-K1-D6
cggacgcgtgggcggacgcgtggggtcggtgctatgctcccgtactggttctcggcggtgaccatgaagagtgtgggcagtgctgcgctcaagatggtggaggaagttcgtcggcagttcaacaacatccctgggctcatggaaggcaccacaaagcctgacta

SEQ ID NO: 7103 - DNA, 429 bp, Zea mays
  Clone ID: LIB3059-036-Q1-K1-B10
cccacgcgtccgccgaaactccgacagtccgaccacaagaaggatgagtgaagaggatgagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttgttgttgagatcacaaagggaagcaaagttaaatatgagcttgacaagaaaactggactgattaaggttgatcgagtcctgtactcatcagttgtataccctcacaattatggtttcgttccaaggactctttgtgaagacaatgacccaatggatgtgttagtcctgatgcaggagcctgttgttcctggttcgttcctgcgagcaagagcaatcggccttatgcc

SEQ ID NO: 7104 - DNA, 399 bp, Zea mays
  Clone ID: LIB3061-035-Q1-K1-C9
cggcccacctggaagccggagagaatcgagcatagccaccgatcgctcctctccactgggcagattccagttccactccgcctccgctgccggtcgccgactccgaaactccgacagtccgaccacaatgatccacatatagatgagtggagaggataaggctgctgcttctgctgagcagccgaagagggcccctaagctcaatgaaaggatcctctcttctctgtccaggaggtccgtagctgctcatacgtggcatgatcttgagatcggtcctgatgctcctgctgttttcaatgttgatgttgagatcacaaagggaagcaaagttaaatatgagctcgacaagaaaactggactgattaaggttgatcgagtcctgtactcatcagttgtata

SEQ ID NO: 7105 - DNA, 390 bp, Zea mays
  Clone ID: LIB3061-032-Q1-K1-A12
ccgcagtgcaggactgaggatgagtgaagaggataaggctgctgcttctgctgagcggcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaactggactgattaaggttgatcgagtcctttactcatcagttgtataccctcacaattatggtttcattccaaggactctttgtgaagacaatgacccaatggatgtgttggtcctgatgcaggagcctgttgttcctggttcgttcctgagagctagagc

SEQ ID NO: 7106 - DNA, 398 bp, Zea mays
  unsure (1)...(398): unsure at all n locations
  Clone ID: LIB3062-044-Q1-K1-F8
cggacgcgtgggcggacgcgtgggcggacgcgtgggccgatcgctcctctccactgtccagattccagttccactccgcctccgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccgtggcatgatcttgagatcggtcctgatgctcctgctgttttcaatgttgttgttgagatcacaaagggaagcanagttaaatatgagcttgacaagaaaactggactgattaanggtgatcgagtcctatactcat

SEQ ID NO: 7107 - DNA, 362 bp, Zea mays
  Clone ID: LIB3068-025-Q1-K1-E5
gggaagcaaagttaaatatgagcttgacaagaaaactggactgattaaggttgatcgagtcctatactcatcagttgtataccctcacaattatggtttcgttccaaggactctttgtgaagacaatgacccattggatgtgttggtcctgatgcaggagcctgttattcctggttcgttcctgcgagcaagagcaatcggccttatgcccatgattgaccagggtgaaaaggatgacaagataatagcagtctgtgctgatgatcctgaatatcgtcactacaacgacatcagtgagctgtcttctcatcgcctgcaagagatcaagcggttctttgaagattattagaagaatgaagatt

SEQ ID NO: 7108 - DNA, 410 bp, Zea mays
  Clone ID: LIB3067-022-Q1-K1-D11
gacccaatggatgtgttggtcctgatgcaggagcctgttgttcctggttcgttcctgagagctagagcaattggccttatgcccatgattgaccagggtgaaaaggatgacaagataatagcagtatgtgctgacgatcctgaataccgtcactacaacgacatcagcgagctgtctcctcaccgcctgcaagagatcaagcgcttctttgaagattacaagaaaaacgagaacaaagaagtcgcagttgatgcattcttgcccgcgacaacagctcaagaagccattcagtactccatggacctgtatgcccagtatattttgcaaagcttgaggcagtagattgcaagcaacaatttatctatcatgcgtcttggatcggggcgtgattttaataagccgaatcgctt

SEQ ID NO: 7109 - DNA, 373 bp, Zea mays
  Clone ID: LIB3067-016-Q1-K1-G4
gctcctctccactttccacattccagttccactccgactgcgctgccggtcgccgactccgaaactccgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatcttgagatcggtcctgatgctcctgctgttttcaatgttggtgttgagatcacacagggatgcaaagcttaatatgaacttgacaagaaaaccggactgattaagggtgatcgagtcctggacttatcagttgtatacccttac

SEQ ID NO: 7110 - DNA, 428 bp, Zea mays
  Clone ID: LIB3067-029-Q1-K1-C6
cccactctccgaaggactctttgtgaatacaatgacccaatggatgtgttggtcctgatgcatgagcctgttgttcctggttcgttcctgagagctagagcaattggccttatgcccatgattgaccagggtgaaaaggatgacaagataatagcagtatgtgctgactatcctgaataccgtcactacaacgacatcagcgagctgtctcctcaccgcctgcaagagatcaagcgcttctttgaagattacaagaaaaacgagaacaaagaagtcgcagttgatgcattcttgcccgcgacaacagctcaagaagccattcagtactccatggacctgtatgcccagtatattttgcaaagcttgaagcagtagattgcaagcaacaatttatctatcatgcgtcttggatcggggcgtgattttaa

SEQ ID NO: 7111 - DNA, 384 bp, Zea mays
  Clone ID: LIB189-031-Q1-E1-D3
aggtcaatacaacgacatcagcgagctgtctcctcaccgcctgcaagagatcaagcgcttctttgaagattacaagaaaaacgagaacaaagaagtcgcagttgatgcattcttgcccgcgacaacagctcaagaagccattcagtactccatggacctgtatgcccagtatattttgcaaagcttgaggcagtagattgcaagcaacaatttatctatcatgcgtcttggatgggggcgtgattttaataagccaaatcgcttgctatattgggaaccttggaattgagaacagcgtcactagctgtgattcgctcctttctcgttaaattatcatatgaataggccaagtccatacgtttaccgtgtggcgctctgtcagtc

SEQ ID NO: 7112 - DNA, 435 bp, Zea mays
  Clone ID: LIB3069-047-Q1-K1-C4
ggtttgcaggcgttgtcttccggattttggtccactacactggtcagcctcttcttggagctaaagttgtagcctccatgctgatgtttgcgacggtcgctgggattctcatggcactcttcttgaacactgctggcggcgcctgggataatgcacagaagtacattgagactggcgctcttggtggcaagggcagcgagtcccacaaggctgcggttactggcgacacggttggagacccattcaaagacactgctggaccgtcgctgcatgttcttatcaagatgctcgccacaatcacgctggtcatggctccgatattcttgtgattaaccaaccactcatcaagcttgctattaaccctgcggagatgtacctatgcgaccaggtagatgaggtgtgtgtgtgtgtgtgttacctgcatgtgatgatgta

SEQ ID NO: 7113 - DNA, 322 bp, Zea mays
  Clone ID: LIB3069-006-Q1-K1-F4
cggacgcgtgcgctcacgtggttgagtctcctatttgcagcaaggttaagtacgacggcgacagggcatctggtctgatcaaggtggaccgtgttctttattcctctgttgtttacccacataactatggcttcattccactgcacactctgtgaggataacgaccccctggatgtcctcatactgatgcaggaacaagttgtccctgtgtgattcctgcgagctcgtgctattgggctcatgcctatgatcgatcaggtctagtgtcttcgtcacctgatcgcatagtgcttgctatgtttaccttaggccatatattttt

SEQ ID NO: 7114 - DNA, 430 bp, Zea mays
  Clone ID: LIB3060-032-Q1-K1-D3
gccgcgttggtggtggtatttataccaaggctgctgatgttggtgctgaccttgtggggaaggtagaaagaaacattcctgaggacgatccaagatacccagctgttattgctgacaatgttggtgataatgcttgagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtct

SEQ ID NO: 7115 - DNA, 415 bp, Zea mays
  Clone ID: LIB3066-051-Q1-K1-D3
aagaaacccagctgttattgctgacaatgttggtgataatgttggagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccagaagacagtgcaaagctggcaattgttcttgtgtgtggcg

SEQ ID NO: 7116 - DNA, 446 bp, Zea mays
  unsure (1)...(446): unsure at all n locations
  Clone ID: LIB3060-026-Q1-K1-G5
caaagctggcaattgttcttgtgtgtggcggttggtctctgggctggcctagtcattggtttggttactgagtactacacaagcaatgcctacagccctgtacaagatgttgctgattcctgcagaactggagcagctactaatgtcatttttgggcttgctttgggttacaaatcagtcattatcccaatttttgctattgcgtttagtatcttcctcagcttcagccttgctgccatgtatggtgttgctgtggctgctcttggaatgctgagcaccattgccacaggtcttgctattgatgcatatggccctatcagtgataatgctggaggaatagctgaaatggctgggatgagccatangattcgtgagagaactgatgctctagatgctgcaggaaataccacggctgcaattggngagggttttgccattggctctgc

SEQ ID NO: 7117 - DNA, 396 bp, Zea mays
  Clone ID: LIB143-018-Q1-E1-D7
accaaggctgctgatgttggtgctgaccttgtggggaaggtagaaagaaacattcctgaggacgatccaagaaacccagctgttattgctgacaatgttggtgataatgttggagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagt

SEQ ID NO: 7118 - DNA, 388 bp, Zea mays
  Clone ID: LIB189-005-Q1-E1-G2
aaatcagatcactttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagataaaggctgtggatgaaatagagcctgctctcaagaaacagctcataatttccacaattgtgatgaccattggcattgcactaatcagttggcttggtcttccatacactttcactattttcaactttggagtccagaagacagtgcaaagctggcaattgttcttgtgtgtggcggttggtctctgggctggcctagtcattggttttg

SEQ ID NO: 7119 - DNA, 458 bp, Zea mays
  Clone ID: LIB3059-035-Q1-K1-G7
gattcctgcagaactggagctgccactaatgtcatttttgggcttgctctgggggacagatcagtcattatcccaatttttgctattgcgtttagtatcttccttagcttcagccttgctgccatgtatggtgttgctgtggctgctcttggaatgctgagtaccattgccacaggccttgctattgatgcctatggccctatcagtgataatgctggaggcatagctgaaatggctgggatgagccataggattcgtgagagaactgatgctctagatgctgcaggaaacaccactgctgcaattggaaagggttttgctattggctctgcagccttggtatcccttgcactcttcggtgcctttgtaagccgggctgctatctccactgttgacgttctgactcctaaagtattcattgggcttattggtggtgctatgctcccatactggttctc

SEQ ID NO: 7120 - DNA, 443 bp, Zea mays
  unsure (1)...(443): unsure at all n locations
  Clone ID: LIB3060-013-Q1-K1-D3
aaccgctgttggcaactgatttcttcgagataaaggctgtggatgaaataaagcctggtctgaagaaacagctcataatttccacaattgtgatgaccattggcattgcactaatcagttggcttggtcttccatacactttcactattttcaactttggagtccagaagacagtgcaaagctggcaattgttcttgtgtgtggcggttggtctctgggctggcctagtcattggttttgttactgagtactacacaagcaatgcctacagccctgtacaagatgttgctgattcctgcagaactggagcagctactaatgtcatttttgggcttgctttgggttacaaatcagtcattatcccaattnttgctattgcgtttagtatcttcctcagcttcagccttgctgccatgtatgngtgtgctgtggctgctcttgga

SEQ ID NO: 7121 - DNA, 430 bp, Zea mays
  Clone ID: LIB3060-010-Q1-K1-G9
ggctctgcagccttggtttcccttgcactatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagttcaacaacatccctgggctcatggaaggcaccacaaagcctgactacgcaacttgtgtcaagatctcaacggatgcatccatcaaggagatgatccccccaagtgctcttgttatgctcacaccactgatcgttgggattctatttggggttgagaccctctctggagtccttgctggtgcccttgtctctggtgttcagattgccatttctgcatccaacactggtggtg

SEQ ID NO: 7122 - DNA, 356 bp, Zea mays
  Clone ID: LIB143-031-Q1-E1-F9
agtggttcttctatggctcttttcggccgcgttggtggtggtatttataccaaggctgctgatgttggtgctgaccttgtggggaaggtagaaagaaacattcctgaggacgatccaagaaacccagctgttattgctgacaatgttggtgataatgttggagatattgctggaatgggatcagatctctttggctcatatgctgaatcatcatgtgctgctcttgttgtggcctctatctcgtcttttggaatcaaccatgaatttactccgatggtgtaccctcttctcgtcagttctgttggtattatagcatgtctcataacaacgctgtttgcaactgatttcttcgagat

SEQ ID NO: 7123 - DNA, 413 bp, Zea mays
  Clone ID: LIB3067-034-Q1-K1-B4
cccacgcgtccgcggacgcgtgggctttggagcccagaagacagtgcaaagctggcaattgtgcttatgtgtggcggttggtctctgggctggcttagtcattggttttattactgagtactacacaagcaatgcctacagccctgtataagatgttgctgattcctgcagaactggagctgccactaatgtcatttttgggcttgctctgggttacaaatcagtcattatcccaatttttgctattgcgtttagtatcttccttagcttcagccttgctgccatgtatggtgttgttgtggctgctcttggaatgctgagtaccattgccacaggccttgctattgatgcctatggccctatcagtgataatgctggaagcttaagtctgtatgggtgcatcttatcatata

SEQ ID NO: 7124 - DNA, 424 bp, Zea mays
  unsure (1)...(424): unsure at all n locations
  Clone ID: LIB3067-010-Q1-K1-A11
cccacgcgtccgattggcattgcgctcatgttggcttggtcttccatacaccttcaccattgataactttggagcccagaagacagtgcaaagctggcaattgttcttatgtgtggcggttggtctctgggctggcttagtcattggttttattactgagtactacacaagcaatgcctacagccctgtataagatgttgctgattcctgcagaactggagctgccactaatgtcatttttgggcttgctctgggttacaaatcagtcattatcccaatttttgctattgcgtntagtatcttccttagcttcagccttgctgccatgtatggtgttgttgtggctgctcttggaatgctgagtaccattgccacaggccttgctattgatgcctatgggcctatcagtgataatgctggaagc

SEQ ID NO: 7125 - DNA, 425 bp, Zea mays
  Clone ID: LIB3060-015-Q1-K1-G3
ggatgagccataggattcgtgagagaactgatgctctagatgctgcaggaaataccacggctgcaattgggaagggttttgccattggctctgcagccttggtttcccttgcactatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagttcaacaacatccctgggctcatggaaggcaccacacagcctgactacgcaacttgtgtcaagatctcaacggatgcatccatcaaggagatgatcccccccagtgctcttgttatgctcacaccactgatcgttgggatt

SEQ ID NO: 7126 - DNA, 409 bp, Zea mays
  Clone ID: LIB3059-024-Q1-K1-G11
cggacgcgtgggcggacgcgtgggtgatccccccaggtgctcttgttatgctcacaggactgatcgttgggattctatttggggttgagaccctctctggagtccttgctggtgcccttgtctctggtgttcagattgccatttctgcatccaacactggtggtgcctgggacaacgccaagaagtacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcga

SEQ ID NO: 7127 - DNA, 283 bp, Zea mays
  Clone ID: LIB3060-038-Q1-K1-B1
ggctctgcagccttggtttcccttgcactatttggtgcgtttgtaagccgggctagtatctccactgttgatgttctgactcctaaagtattcatcgggcttattgtcggtgctatgctcccgtactggttctcggcaatgaccatgaagagtgtgggcagtgctgcgctcaagatggtggaggaagttcgtcggcagttcaacaacatccctgggctcatggaaggcaccacaaagcctgactacgcaacttgtgtcaagatctcaacggatgcatccatca

SEQ ID NO: 7128 - DNA, 421 bp, Zea mays
  Clone ID: LIB143-008-Q1-E1-B6
cttgtctctggtgttcagattgccatttctgcatccaacactggtggtgcctgggacaacgccaagaagtacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgctgcccatggtggcattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgtatttggtttccgttttct

SEQ ID NO: 7129 - DNA, 424 bp, Zea mays
  Clone ID: LIB143-021-Q1-E1-A12
gtgatgattaatctcagcatactgtttaagtttccccatgcttcaatgtctgcatccaacactggtggtgcctgggacaacgccaagaagtacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgt

SEQ ID NO: 7130 - DNA, 410 bp, Zea mays
  unsure (1)...(410): unsure at all n locations
  Clone ID: LIB143-037-Q1-E1-C3
aggaatagctgaaatggctgggatgagccataggattcgtgagagaactgatgctctagaatctgcaggaaattacaaggctgcaattgggaanggttttggcattggctctgcaaccttggtttcccttgcactaatttgtgcgtttgttagccgggctgctatctccactgttgatgttctgactcctaaagtattcatcgggcttattgtcggtgctatgctcncgtactggttctcggcaatgaccatgaagagtgtgggcagtgctgcgctcaagatggtggaggaagttcgtcggcagttcaacaacatccctgggctcatggaaggcaccacaaagcctgactacgcaacttgtgtcaagatctcaacggatgcatccattcaagagatgatccccccaggtg

SEQ ID NO: 7131 - DNA, 408 bp, Zea mays
  Clone ID: LIB3079-004-Q1-K1-D5
cggacgcgtccgcccacgcgtccgcctacgcgtccgcctgggacaacgccaagaaggacattgaggctggagtttcagagcatgccaggacccttggcccaaaaggttctgaccctcacaaggcggctgtcattggtgacaccattggagatcctctcaaggacacgtctggcccttccctcaacatcctcatcaagcttatggcggttgaatcccttgtcttcgcccccttcttcgccgcccatggtggcattctcttcaaatggctctaagccagcgagagacgcaggataaaggccgtagttttgcaaggcgagtagagcagtatgtcagtaatacagcatctatggcatgtgcttttgctcgtccagttcatgagccccgttgtgtatttggtttcccgtttct

SEQ ID NO: 7132 - DNA, 202 bp, Zea mays
  Clone ID: LIB143-028-Q1-E1-F3
acccacgcgtccgcccacgcgtccgcccacgcgtccgcccacgcgtccgatttggtgcgtttgtaagccgggctgctatctccactgttgatgttctgactcctaaagtattcatcgggcttattgtcggtgctatgctcccgtactggttctcggcaatgaccatgaagagtgtgggcagtgctgcgctcaagatggtgga

SEQ ID NO: 7133 - DNA, 441 bp, Zea mays
  unsure (1)...(441): unsure at all n locations
  Clone ID: LIB3068-043-Q1-K1-A2
gggacaacgccaagaagtacattgaggctggagtttcagagcatgccaagacccttggcccaaaagggtctgaccctcacaaggcggctgtcattggtgacaccattggagatccctctaaggacacgtctggccctttcctcaacatcctcatcaagcttatggcggttgaatcccttgtcttcgcccncttcttcngccgccatggtggcattctcttcaaatggctctaagccagcgagagacgcangataaaagccgtagttttgcaaggcgagtagagcagtatgtcagtaatacagcatctatggcatgtgcttttgctcgtccagttcatgagccccgttgtgtatttggtttccgttttcttggttggagtttttagttccaaagtccgatcatgttttgatcccataaattctcttccagccttcgagcaac

SEQ ID NO: 7134 - DNA, 316 bp, Zea mays
  Clone ID: LIB3066-031-Q1-K1-E3
cggacgcgtgggctttgctgttgtgatcttcctcttccttggttcggttgagggattcagcgacgaagagccagccctgcacctatagcaaggacaagtactgcaagcctgcactgttcactgcactctttagcactgtgtccttcttgcttggagccatcacctctctggtctccggtttccttggcatgaagattgccacatatgcgaatgccagaactaccctggaagctatgaagggtgttggcaaggcttttatcaccgcttttcgctctggtgctgttatgggcttcctgcttgcatcaagtgggcttgt

SEQ ID NO: 7135 - DNA, 335 bp, Zea mays
  Clone ID: LIB143-001-Q1-E1-G11
gcttcgaggaaggaaaaccctaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgccgagatccagaccgccatctctgaaggagctacatctttccttttcactgagtacaagtatgttg

SEQ ID NO: 7136 - DNA, 468 bp, Zea mays
  Clone ID: LIB3066-001-Q1-K1-B7
atcgccgtgtgcgccgacgaccccgagtaccgtcactacaacgacatcagcgagctctgccctcaccgcctacaggagatccgccgcttcttcgaagactacaagaagaacgagaacaaggaggtggccgtcaacgacttcctgcccgccgccgctgcccgcgaagccatccagtactgcatggacctgtacgggcagtacatcatgcagaccctgcggcggtagagcgtgtcctaccagatcccatgcgagctgagctgacgcaagagcacagatcgacagaatccttgtggtctagtctcatgcatggatagccaggtcacatggcttgtcgacgaccatgcatctgttcttcccagcgattctagcctgtatctgcccttatttatagtctcttgggtttggtggaatctgtccacagtgtggcttgatctatgtactactcttctacatttctaccagaacgaa

SEQ ID NO: 7137 - DNA, 387 bp, Zea mays
  Clone ID: LIB143-061-Q1-E1-E10
cactcatcattagctctgtgggtatcatagcttgcttgataaccactctttttgcaactgatttctttgagatcaaggctgtagatgaaattgagccggctctcaagaagcagcttataatttccactgctgtgatgactgttggcattgcacttgtcagttggttagggcttccatatacattcacaatcttcaactttggtgtgcagaagacggtgtataactggcaattattcctatgcgtggcagttggtctgtgggcaggactagttattggatttgttacggagtattacacaagcaatgcatacagtcctgtacaggatgttgctgactcctgcagaactggagctgctacgaatgtcatctttgggcttgctctgggat

SEQ ID NO: 7138 - DNA, 420 bp, Zea mays
  Clone ID: LIB189-020-Q1-E1-C10
gaaggtcgaattcgctaggccatggttacgacagccgtctcgacccacgcgtcagcccacgcgtccgcggacgcgtgggtgaattcacccctatgttgtacccactcctcattagctctgtgggtatcatagcttgcttgataaccactctttttgcaactgatttctttgagatcaaggctgtagatgaaattgagccggctctcaagaagcagcttataatttccactgctgtgatgactgttggcattgcacttgtcagttggttagggcttccatatacattcacaatcttcaactttggtgtgcagaagacggtgtataactggcaattattcctatgcgtggcagttggtctgtgggcaggactagttattggatttgttacggagtattacacaagcaatgcatacagtcctg

SEQ ID NO: 7139 - DNA, 481 bp, Zea mays
  Clone ID: LIB189-028-Q1-E1-C4
gcctggcgcagcgtcagttgccagcacggtctagcaatccggtcggccacgcgtccgaggaaacgtgggcggacgcgtgggcacgcacactctgtgaggataacgaccccctgaatgtcctcatactgatgcaggaacaagttgtccctgggtgtttcctgcaagctcgtgctattgggctcatgcctatgatcgatcagggcgagaaagatgataagattatagcagtctgtgctgatgaccctgaattccgtcactacacggacatcacggacctcccaccgcatcgccttcaagagatccgccgcttttttgaagattataaaaagaacgaaaataaggaggtcgcagtgaatgagttcctgccagcgaaagatgccatcaacgcaatcaagtactcgatggacctgtatggctcatacgtcatcgaaagcctgaggaagtgatctccagctgcttgattgtggttgtggatgctaca

SEQ ID NO: 7140 - DNA, 416 bp, Zea mays
  Clone ID: LIB143-026-Q1-E1-C1
cccacgcgtccgcatccatgtccaggaggtctgttgctgcacacccttggcatgatctggagataggtcctggtgctccaaccatattcaactgcgtcattgagataccaaggggcagcaaggttaaatatgaacttgacaagaaaactggactgatcaaggtggaccgtgtgctgtattcatcagttgtttaccctcacaactatggattcattcctcgcacgctttgtgaagacagtgatcctttggatgtactggttataatgcaggagcctgttatcccaggctgtttcctacgtgcgaaggccatcggccttatgccgatgattgatcagggagaggcagatgacaagatcattgcagtgtgcgctgatgatcccgagtacaggcattacaatgatatcaaggagctccca

SEQ ID NO: 7141 - DNA, 400 bp, Zea mays
  unsure (1)...(400): unsure at all n locations
  Clone ID: LIB3068-013-Q1-K1-H2
cccacgcgtccgtggattcattcctcgcactctttgtgaagacagtgatcctttggatgtactggttataatgcaggagcctgttatcccaggctgtttcctacgtgcgaaggctatcggccttatgccgatgattgatcagggagaggcagatgacaagatcattgcagtgtgcgctgatgatcccgagtacaggcattacaatgatatcaaggagctcccacctcaccgcttggctgaaatcaggcgcttcttcgaggactacaagaagaatgagaacaaggaggttgctgtgaacgactntctaccagcgagcgccgcttatgaagccatacagcactctatggatctgtatgctacatacatcngtgagggcctgangaggtaagattctgatggc

SEQ ID NO: 7142 - DNA, 457 bp, Zea mays
  unsure (1)...(457): unsure at all n locations
  Clone ID: LIB3062-033-Q1-K1-D2
acgctttccccgtcggcgcctactcagatttaattcggacgccgccgccgccgctgacccagggggtcttgatggcgcccgctgtagaagccgttaaggagacaggctcgttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaaactggactgatcaaggtggaccgtgtgctgtattcgtcagttgtttaccctcacaactatggattcattcctagcactctctgtgaagacagtgatcctttggatgtactggttataatgcatgagcctgttatcccatgctgnttcctacgtgcgaaggctatcggccttatgcc

SEQ ID NO: 7143 - DNA, 411 bp, Zea mays
  Clone ID: LIB3062-057-Q1-K1-B7
acgctttccccgtcggcgcctcctcagatttaatttggacgccgtcggcgccgctgacccaggtggtcttgatggcgcccgctgtagaagccgtgaaggagacaggctcgttccatatggttcctgccttgaacgaaaggatactgtcatccatgtccaggaggtctgatgctgcacacccttggcatgatctggagatagcgtcctggtgcttcaaccatattcaactgcgtcattgagataccaaggggcagcaaggttaaatatgaacttgacaagaaaactggactgatcaaggtggaccgtgtgctgtattcgacagttgtttaccctgacaactatggattcattcctcgcactctttgcgaagacagtgatccttttgatgtactgggtattattcaagaacct

SEQ ID NO: 7144 - DNA, 423 bp, Zea mays
  Clone ID: LIB3062-001-Q1-K2-H5
atcaggcgcttcttgtagtcctcgaagaagcgcctgatttcagccaagcggtgaggtgggagctccttgatatgattgtaatgcctgtactcgggatcatcagcgcacactgcaatgatcttgtcatctgcctctccctgatcaatcatcggcataaggccgatagccttcgcacgtaggaaacagcctgggataacaggctcctgcattataaccagtacatccaaaggatcactgtcttcacaaagagtgcgaggaatgagaacaaggaggttgctgtgaacgactttctaccagcgagcgccgcttatgaagccatacagcactctatggatctgtatgctacatacatcgttgagggcctgaggaggtaggattctgatggctaggaaagtggggaggatgttgacgaaaaactgggag

SEQ ID NO: 7145 - DNA, 340 bp, Zea mays
  Clone ID: LIB189-022-Q1-E1-D5
acgcggacgcgtgggcggacgcgtgggcggacgcgtgggctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaaactggactgattcaaggtggacgtgtgctgt

SEQ ID NO: 7146 - DNA, 438 bp, Zea mays
  unsure (1)...(438): unsure at all n locations
  Clone ID: LIB189-012-Q1-E1-F4
ctgggaacgttacccagcggtcaccgtgctagcatncgggtaccaccacgcgtccgcagacgcgtggacgcgtgccatcctagggtttctttccccgtcggcgcctcnccagatttggccgccgccgccgctgacccaggttgtcttgatggcgcccgctgtagaagccgtgaaggagacaggcaccttccagaaagttcctgccttgaacgaaaggatactgtcatccatgtccaggaggtctgttgctgcacacccttggcatgatctggagataggtcctggtgctccaaccatattcaactgcgtcattgagataccaaggggcagcaagggtataatatgaacttggaggggaagactggactgattcaagtggaccgtgtgctgtattcaacagttgtttaccctcacaacaatggattcattcctcgcacg

SEQ ID NO: 7147 - DNA, 419 bp, Zea mays
  Clone ID: LIB36-015-Q1-E1-D6
ggccatttctttggatgacccgaaagcatctcttgtgaacgacgtggatgatgttgagaagcattttccggggacactgactgccatcagagactggttcagagactacaagatacctgatggaaagcctgccaacaaatttggtctcggcaacaagcccgcaagcaaggaatacgccctgaaggtcattcaagagaccaacgaatcatgggagaaattggtaaagagaaatattcccgctggagagctctcgttggcctgattttggcccatggaagccaccacattcttttgaactgctttcgtgagcatgtcgttttgtatgctgtgaccatgcttcttcgtttgcattccaaaccttttttacgaactgtttaacaaaaatgatcttgtcggataaataatgattctggtgcgag

SEQ ID NO: 7148 - DNA, 428 bp, Zea mays
  Clone ID: LIB83-016-Q1-E1-H7
cacacgcgtccggggaggacccaacttctgcaaattctgaggttgaaggagcatttggggataatgatcctgttgatgttgttgagataggtgaaagacgtgccaatgtcggggacgttcttaaggttaagccattggcagctttagcaatgattgatgagggagagcttgactggaaaattgtggccatttctttggatgacccgaaagcatctcttgtgaacgacgtggatgatgttgagaagcattttccggggacactgactgccatcagagactggttcagagactacaagatacctgatggaaagcctgccaacaaatttggtctcggcaacaagcccgcaagcaaggaatacgccctgaaggtcattcaagagaccaacgaatcatgggagaaattggtaaagagaaatattcccgctgga

SEQ ID NO: 7149 - DNA, 415 bp, Zea mays
  Clone ID: LIB148-019-Q1-E1-H8
actggaatgggatctgatctctttgggtcatacgcagagtcttcttgtgctgcccttgttgttgcgtctatttcatctttcggaatcgaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccaccgtcctgatgacttttggtattgctctaatcagctggttggcccttccagctaagttcaccatctacaacttcggtactcagaaggaggtttccaactggggtttgttcttctgtgtttcaattggtctgtgggctggtttgattaatgggtttgtcacagaatactacacta

SEQ ID NO: 7150 - DNA, 409 bp, Zea mays
  Clone ID: LIB3066-040-Q1-K1-D6
cccacgcgtccgcccacgcgtccgatgtctgtgaaagaaattgagcctgcacttgggagcagctcatcatctccaccgtcctgatgatttttggtattgctctaatcagctggttggcccttccagctaagttcaccatctacaacttcggtactcagaaggaggtttccaactggggtttgttcttctgtgtttcaattggtctgtgggctggtttgattattggttttgtcacagaatactacactagcaatgcatacagtcccgtgcaagatgttgcggattcgtgcagaactggtgctgccactaatgtcatttttggtcttgctcttggatacaagtcggttatcatcccgattttcgctattgctgttagcatctatgtcagtttctccattgctgcgatgta

SEQ ID NO: 7151 - DNA, 425 bp, Zea mays
  Clone ID: LIB148-004-Q1-E1-B10
ttgaaaaggtgtacctgtcagtatacggtctagacctcgcgggccgaccaacgcgtccacccacgcgtccgctgataatgtcggtgacaatgttggtgacattgctggaatgggatctgatctctttgggtcatacgcagagtcttcttgtgctgcccttgttgttgcgtctatttcatctttcggaatcgaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccaccgtcctgatgacttttggtattgctctaatcagctggttggcccttccagctaagttcaccatctacaacttcggtactc

SEQ ID NO: 7152 - DNA, 367 bp, Zea mays
  Clone ID: LIB3068-036-Q1-K1-A10
cggactcgtgggcggactcgtgggtttgattattggttttgtcacagaatactacaggagcaatgcatacagtcccgtgcaagatgttgcggattcgtgcagaactggtgctgccactaatgtcatttttggtcttgctcttggatacaagtcggttatcatcccgattttcgctattgctgttagcatctatgtcagtttctccattgctgcgatgtacggcattgcagttgccgctcttgctattgatgcttatggtgccatcagtgacgatgctgatgctattgctgagatggctgacatgagccacagaatcgctgagagaactgatgctatcgacgctactggcaacagaactgctgctatt

SEQ ID NO: 7153 - DNA, 394 bp, Zea mays
  Clone ID: LIB143-025-Q1-E1-C10
tgggacaatgccaagaagtacatcgaggctggtgccagcgagcacgcgaggaccctcggtcccaagggatccgactgccacaaggccgctgtgatcggtgacaccattggtgaccccctgaaggacacctccggcccgtccctcaacatcctcatcaagctcatggccgtggagtccctcgtgtttgcccccttctttgccacccagggtggcctgctcttcaagtacctgtaacagggacaacaccaagcacacagcagaagtatacgatctcccgaccgaccgtggacaatatcgaataactcctgccaaatcgccagttccttttgtgtactgtgcgctagccgccgcctagctgcactgctgtatttttgtttcaggattgctgctgctg

SEQ ID NO: 7154 - DNA, 429 bp, Zea mays
  Clone ID: LIB148-033-Q1-E1-A7
agtacatcgaggctggtgccagcgagcacgcgaggaccctcggtcccaagggatccgactgccacaaggccgctgtgatcggtgacaccattggtgaccccctgaaggacacctccggcccgtccctcaacatcctcatcaagctcatggccgtggagtccctcgtgtttgcccccttctttgccacccagggtggcctgctcttcaagtacctgtaaaagggacaacaccaagcacacagcagaagtatacgatctcccgaccgaccgtggacaatatcgaataactcctgccaaatcgccagttccttttgtgtactgtgcgctagccgccgcctagctgcactgctgtatttttgtttcaggattgctgctgctgttcgcattcaatctttgggcctcccggagccgccggaggcgcgttttactg

SEQ ID NO: 7155 - DNA, 326 bp, Glycine max
  unsure (1)...(326): unsure at all n locations
  Clone ID: 700651291H1
tggccctatttggtgcatttgtgagcagagctggaattttgactgttgatgtcttgactcccaaggtctttattggactcatagttggtgccatgcttccttactggttttctgccatgaccatgaagagtgttggaagtgcagctttgaagatggttgaggaggttcgtaggcagttcaacaccattccaggactgatggaggtcagccaagcctgatatgccactgcgtcaaattctactgagcaccacaagagagatctcggtgccttgcagtcaacatcatgtgganctctcgggtgaaattcaggtctcgggtnattctgt

SEQ ID NO: 7156 - DNA, 322 bp, Glycine max
  unsure (1)...(322): unsure at all n locations
  Clone ID: 700652792H1
catgagttgactgctatgttataccctctaatnatcagttctgtgggtatccttgtttgtttgctcacaactttatttgcaactgacttctttgagatcaaggctgtaaaggagatgagctgcattgaagaaacagctcatcattcccactggcttgatgactattggatgcaattgtagttggatgcactccaacttccttcacatcttcatttggagtncagaagagtcagaatggcactatctgtgtgtgcgtggcttgggcaggcttatattggattgtacgagtactatactagcatgcatatagccgtncagngtg

SEQ ID NO: 7157 - DNA, 263 bp, Glycine max
  unsure (1)...(263): unsure at all n locations
  Clone ID: 700656683H1
cgtcaaaatttctactgatgcatccatcaagnagatgattcctccgggtgccctncgtnangctcanaccactcattgttggnatcttcttcggggtggaaacactttcaggtgttcttgccggggctctagtttctggtgtacagattgcaatatcagcatccaacactggcggtgcttgggataatgctaagaagtacatagaggctggtgcgtctgagcatgcaaggaccctgggcccgaaggatctgaaccacataagg

SEQ ID NO: 7158 - DNA, 243 bp, Glycine max
  unsure (1)...(243): unsure at all n locations
  Clone ID: 700660662H1
ctgagttccgccattacactgacatcaatgagcttcctccacatcggcttgctgaaatcagaagattctttgaggactacaagaagaatgagaacaaaatagttgatgttgaagactttctaccggctgaagctgccattgatgccatcaattactccatggacttgtatgctgcttacatagttgagagctaaggnactaacttctctanagacnntgtancncnntnngngngctctccaa

SEQ ID NO: 7159 - DNA, 281 bp, Glycine max
  unsure (1)...(281): unsure at all n locations
  Clone ID: 700744202H1
tactcggctcgagctgcaatgtatggcattgctgtggctgcccttgggatgctgagcaccattgcgactccgatggctattgatgcctatgggccaatcagtgacaatgcaggaggtattgacgtgatggcaggcatgagccatcgtattcgtgagagaactgatgcccatgatgcttctggcaacacttcngtggncataggcaagggatttgctatnggggctgccgctctggtgtctttggccctatttggtgcatttgtgagcagagctggaattca

SEQ ID NO: 7160 - DNA, 233 bp, Glycine max
  Clone ID: 700755514H1
ctgccaacatccttcaatattatcaactttggcgctcagcaggcagtaaagagctggcagctgtgcctctgtgtgggtgttggtctatgggctggacttattattggttttgttacagcgtattatacaagcaatgcttacagccctgtaccagatgttactgattcctgctggactggagctggaaccaatgtcacctgtggccttgctctgggatacaagtctgtgattat

SEQ ID NO: 7161 - DNA, 254 bp, Glycine max
  Clone ID: 700837007H1
ggagccagttcttccaggttgctttctacgggccaaagctattggactcatgcctatgattgatcagggtgagaaagatgacaagataattgctgtctgtgctgatgatcctgagtataggcattacaatgatatcaaggaccttcctcctcaccgtttagctgaaattcgtcgtttctttgaagattacaagaagaatgagaacaaggaagttgcagtgaacgactttcttcctgcttcagctgcctatgaag

SEQ ID NO: 7162 - DNA, 256 bp, Glycine max
  Clone ID: 700865679H1
tagctggtgcagttatgggttttctccttgctgcaaatggtcttttggttctttacattgccatcaacttgttcaaggtttactatggtgatgactgtggtggtcttcttgtggccatcactggttatggtcttggtgggtcttctatggctttgtttggaagagttggtggaggtatctatactaaggctgctgatgttggtgctgatcttgtcggaaaggttgaaagaaacatctccgaagatgatccaagaaa

SEQ ID NO: 7163 - DNA, 246 bp, Glycine max
  Clone ID: 700890647H1
gcattattgtctgtttgattactactctctttgcaactgatttctttgagatcaaggctgtcaaggaaattgaaccagctttgaaaaagcagcttatcatctctacagtactcatgactgttggaattgcaattattagttggattgctctgccaacatccttcacaattttcaactttggcgctcagaaggaagtaaagagctggcagctgttcctctgtgtgggtgttggtctatgggctggac

SEQ ID NO: 7164 - DNA, 259 bp, Glycine max
  Clone ID: 700942978H1
caacactggcggtgcttgggataatgctaagaagtacatagaggctggtgcgtctgagcatgcaaggaccctgggccagcaaggatctgaaccacataaggcagctgttattggagataccattggagaccctcttaaagatacttcaggtccttcactcaacatcctcatcaagctcatggccgttgagtcgctcgtcttcgcaccatttttcgccactcacggtggcctgcttttcaagatcttttgatttgagggt

SEQ ID NO: 7165 - DNA, 188 bp, Glycine max
  Clone ID: 700944280H1
gcctctgttccgccaagcgcagataagacccaccgttcaggccaccggctgagttaggtttccggcgaggatcggtgctgctctgctgtcggagcttgcgacggagatagtcgtgccagtgtgcgccgtcatcgggatcgggtcctggctggtgcagtggttcctcgtgtcgcgcgtcaagctcactc

SEQ ID NO: 7166 - DNA, 242 bp, Glycine max
  Clone ID: 700974544H1
ctgctggcaacactactgctgccataggcaagggatttgctattgggtctgccgctctggtgtctttggccctatttggtgcatttgtgagcagggctggaatttcaactgttgatgtcttgacacccaaggtctttattggactcatagttggtgccatgcttccttactggttttccgctatgaccatgaagagtgttggaagtgcagctttgaagatggttgaggaggttcgtaggcag

SEQ ID NO: 7167 - DNA, 313 bp, Glycine max
  unsure (1)...(313): unsure at all n locations
  Clone ID: 700984449H1
gctctgtgngaaggcttcagtactaagancnagncctgcacatatgatnagangcgagctatanaagccagcccntgncgacttgcnttgnttagccctgtcatctntcntggcntggtgctatnacttcngtcctatcnngnntccttaggctannaattgncagcctgtgccaatgcnaggacnaaccttagcagccaganagggagttggataggctttgnatactgcatttaggnctggtgcagtgatgggtttccnncntggnggaaatggtcttntggngnnctacattnaccatcaatctcttcag

SEQ ID NO: 7168 - DNA, 119 bp, Glycine max
  unsure (1)...(119): unsure at all n locations
  Clone ID: 700989248H1
cccatggcntgaccttgagatcggacctggngctccaattntcntcaattgtgtgattnaaattgggnnagggancnaggngaaatntgnactggacacaaagtcggggctnatcaang

SEQ ID NO: 7169 - DNA, 265 bp, Glycine max
  unsure (1)...(265): unsure at all n locations
  Clone ID: 701002440H1
gccactgctgttttcagcaccatatctntcctgcttggaggtgtcacatcgcttatttctggattccttggaatganaattgcaacnnatgccaatgcaagaaccaccctggaggcaagaaagggtgttggaaaggctttcattacggcttttagatctggtgcagttntgggttctccccntngtgaaagggtctngtggtttncnanancgccnancnncttgaaanatatttacgntggtgaggagtgggntggtcnagccc

SEQ ID NO: 7170 - DNA, 274 bp, Glycine max
  Clone ID: 701003295H1
gcctgaaagtgtccgagagataactgatgtccttgatgccgtaggaaacacaaccaaagctaccaccaaagggtttgctattggttctgctgctcttgcatctttccttttgtttagtgcttatatggacgaggtttctgcatttgctcatgaaccttttaaacaggttgatattgctattcccgaagttttcgttggtgggctgctaggttccatgcttatatttgtttttagtgcttgggcctgtgctgctgttggcagaactgcacaagaa

SEQ ID NO: 7171 - DNA, 291 bp, Glycine max
  Clone ID: 701012101H1
gccagctcttggtactgctgttttcagcaccatatctgtcccgcgtggtggtgtcacatcgcttattgtctggattccttggaatgaaaacttcaacttacgccaatgcaagaaccaccctggacgcaagaaagggtgttgggaaggctttcattacggcttttagatctggtgcagttatcggttttctccgtgctgcaaatggtcttttggggctttacattggcatcaacttgttcaagatttactatggtgatgactggtgtggtcttttgaggccatcactggtta

SEQ ID NO: 7172 - DNA, 241 bp, Glycine max
  Clone ID: 701097188H1
cctcattcttatttctttcctctcttcactttcactctctctctctctctcagccatcatcatgggagcagtgattctcccagatctcggcactgagattttgattccggtctgcggcatcatttgaatagggttcgccctcttccagtgggtcctcgtctccaaggttaatctctcctttggcagagacgcttcccctaacgccgctggcaaaaatggttacaacgattacctcatcgaa

SEQ ID NO: 7173 - DNA, 284 bp, Glycine max
  Clone ID: 701105007H1
agggaaggtctttttgaggctataactggttatggtttgggtggatcttccatggctctgtttggcagagttggtggtggtatctataccaaggctgctgatgttggtgctgatctggttggaaaagttgagagaaatatcccagaggatgatccaagaaatccagctgtgattgctgacaatgttggtgataatgttatatcccctactcatcagttctatgggcattattgtctttgattactactctctttgcaactgatttctttgagatcaaggctgtc

SEQ ID NO: 7174 - DNA, 263 bp, Glycine max
  Clone ID: 701106870H1
gcgcaacccagctgttattgcagacaacgtaggagctaatgttggagatatcgctgggatgggttcagacttatttgggtcttatgcagaatcatcatgtgcagctttatttgtagcatccatatcatcgtttggaacaaatcatgatcacacagccatgtcatatcctctcatcataagctccatgggaattgtggtttgcttgattacgactctttttgcaactgatctgtttgaacttaaaaacgtgagccaaatagaac

SEQ ID NO: 7175 - DNA, 168 bp, Glycine max
  Clone ID: 701122796H1
cggctcgaggggagaggaagcaaggtgagatatttacttgacaaaagaactggaaatattatggttgatcgtatactacactcatcagtagtttatcctcacaactatgggaatattccacgtactatttgtgaggacagtgatcccatggatgtcttgggtattatg

SEQ ID NO: 7176 - DNA, 246 bp, Glycine max
  Clone ID: 701124682H1
ctgcacttgtgtctcttgcattgtttggtgcttatgtgagcagagcaggcatcaaaacagtgaatgtgatgaccccaaaagtttttataggtttgattgtgggagcaatgcttccctactggttttcagccatgacaatgaagagtgtcgggagtgcagctctcaaaatggttgaagaagttcgtaggcaattcaataccattcccggtcttttagaaggaagagcaaaacccgattatgcaaatt

SEQ ID NO: 7177 - DNA, 194 bp, Glycine max
  Clone ID: 701132123H1
cgcgttcactgcaatgttatatcccctactcatcagttctatgggcattattgtctgtttgattactactctttttgcaactgatttctttgcgatcaaggctgtcaaggaaattgaaccagctctaaaaaagcagcttatcatctctacagtactcatgactgttggaattgccattattagttggattgctc

SEQ ID NO: 7178 - DNA, 190 bp, Glycine max
  Clone ID: 701136557H1
gtgatcccctggatgtcttgattattatgcaggagccggttcttccaggttgctttcttcgggccaaagcaattggtctcatgcccatgattgatcagggggagaaagatgataaaattattgctgtctgtgctgatgatcctgagtatagacattacaatgatatcaaagagcttcctccacatcgttt

SEQ ID NO: 7179 - DNA, 212 bp, Glycine max
  Clone ID: 701148551H1
tgcatatggtccaatcagtgacaatgctggaggtattgctgaaatggctggtatgagtcacagaattagagagagaactgatgcccttgatgctgccggaaacacgactgccgctattgggaagggatttgccattggttctgctgcccttgtatcactggccctctttggtgcctttgtaacccgatctgctatcacaactgtagatgtgt

SEQ ID NO: 7180 - DNA, 275 bp, Glycine max
  Clone ID: 701206188H1
ggcattctgctcgatctcgagccgattcggctcgagggagttggcaaggctttcattactccatttaggtctggtgcagtgatgggtttccttcttgcagcaaatggtcttttggtgctctacattaccatcaatctcttcaagctatattatggtgatgattgggaaggactttttgaggctataactggttatggtttgggtggatctaccatggctctgtttggcagagttggtggtggtatctataccaaggctgctgatgttggtgctga

SEQ ID NO: 7181 - DNA, 131 bp, Glycine max
  Clone ID: 701211207H1
caaaacgccatttccgaaggatcaacctctttccttttcactgaatataaggacgtgggaatcttcatggtggcttttgccattttgatattcctctgccttgagctctgtggaaggattcagcacaagct

SEQ ID NO: 7182 - DNA, 269 bp, Glycine max
  unsure (1)...(269): unsure at all n locations
  Clone ID: 700987644H1
ctggctggncccacacctgtggactagtagatgaaacaggaaacccanctggtgggcngtttggcacagctgtggcaacaatgggaatgcttagcactgctgcctatattcttaccatggatatgtttggcccaatagctgataagctggagganttgtagagatgagtcagcagcctgaaagtgtccgagagataactgatgtccttgatgccgtaggaaacacaaccaaagctaccaccaaagggtttgctattggttctgctgctc

SEQ ID NO: 7183 - DNA, 265 bp, Glycine max
  Clone ID: 700955418H1
gtttgtttgctcacaaccttatttgcaactgacttctttgagatcaaggctgtaaaggagattgagcctgcattgaagaaacaactcatcatttccactgccctgatgactattgggattgcaattgttagttggatgcactcccaacttccttcactatcttcaattttggagttcagaaagatgtcaagaattggcagctattcttgtgtgttgctgttggtctttgggcaggtcttattattggatttgtaactgagtacta

SEQ ID NO: 7184 - DNA, 249 bp, Glycine max
  Clone ID: 701054053H1
ctttgatatcaaggctgtaaaggagattgagcctgcattgaagaaacagctcatcatttccactgccttgatgactattgggattgaattgttagttggattgcactcccaacttccttcactatcttcaattttggagtgcagaaagatgtcaagaattggcagctattcttgtgtgttgctgttggtctttgggcagggcttattattggatttgtaactgagtactatactagcaatgcatatagt

SEQ ID NO: 7185 - DNA, 259 bp, Glycine max
  Clone ID: 700846717H1
cattgggattgcaattgttagttggattgcactcccaacttccttcactatcttcaattttggagttcagaaagatgtcaagaattggcagctattcgtttgtgttgctgttggtctttgggcaggtcttattattggatttgtaactgagtactatactagcaatgcatatagtccggtgcaagatcgttgcagactcctgcaggactggtgctgcaactaatgttatatttggccttgccttgggatacaagtctgt

SEQ ID NO: 7186 - DNA, 256 bp, Glycine max
  Clone ID: 700952212H1
catcatttccactgccttgatgactattgggattgcaattgttagttggattgcactcccaacttccttcactatcttcaattttggagtgcagaaagatgtcaagaattggcagctattcttgtgtgttgctgttggtctttgggcagggcttattattggatttgtaactgagtactatactagcaatgcatatagtccggtgcaagacgttgcagactcctgcaggactggtgctgcaactaatgttatcttt

SEQ ID NO: 7187 - DNA, 274 bp, Glycine max
  Clone ID: 701156608H1
acgacagaaggggtatccttgtttgtttgctcacaaccttatttgcaactggcttctttgagatcaaggctgtaaaggagattgagcctgcattgaagaaacaactcatcatttccactgcctgatgactattgggattgcaattgttagttggattgcactcccaacttccttcactatcttcaattttggagttcagaaagatgtcaagaattggcagctattcttgtgtgttgctgttggtctttgggcaggtcttattattggatttgta

SEQ ID NO: 7188 - DNA, 250 bp, Glycine max
  Clone ID: 700959847H1
gttggattgcactcccaacttccttcactatcttcaattttggagttcagaaagatgtcaagaattggcagctattcttgtgtgttgctgttggtctttgggcaggtcttattattggatttgtaactgagtactatactagcaatgcatatagtccggtgcaagatcgttgcagactcctgcaggactggtgctgcaactaatgttatatttggccttgccttgggatacaagtctgttattattccaa

SEQ ID NO: 7189 - DNA, 278 bp, Glycine max
  unsure (1)...(278): unsure at all n locations
  Clone ID: 700986383H1
tgactatngggattgcaattgtnagttggattgcactcccaacttccttcactatcttcaattttggagttcagaaagatgtcaagaattggcagctattcttgnntgttgctgttggtctttgggcaggtcttattattggatttgtaactgagtactatactagcaatgcatatagtccggtgcaagatgttgcagactcctgcaggactggtgctgcaactaatgttnatatttggccttgcctgggatacaagtctgttatatccaattttgct

SEQ ID NO: 7190 - DNA, 255 bp, Glycine max
  Clone ID: 700892594H1
ataggagattgagcctgcattgaagaaacagctcatcatttccactgccttgatgactattgggattgcaattgttagttggattgcactcccaacttccttcactatcttcaattttggagtgcagaaagatgtcaagaattggcagctattcttgtgtgttgctgttggtctttgggcagggcttattattggatttgtaactgagtactatactagctatgcatatagtccggtgcaagacgttgcagactc

SEQ ID NO: 7191 - DNA, 241 bp, Glycine max
  Clone ID: 700995882H1
cttgtttgtttgctcacaactttatttgcaactgacttctttgagcatcaaggctgtaaaggagattgagcctgcattgaagaaacagctcatcatttccactgccttgatgactattgggattgcaattgttagttggattgcactcccaacttccttcactatcttcaatttggagtgcagaaagatgtcaagaattggcagctattcttgtgtgttgctgttggtctttgggcagggc

SEQ ID NO: 7192 - DNA, 206 bp, Glycine max
  Clone ID: 701099843H1
ctctcgagccgaatcggctcgaggaaagatgtcaagaattggcagcacttcttgtgtgttgcagttggtctttgggcaggtcttattattggatttgtaactgagtactatactagcaatgcatatagtccggtgcaagatgttgcagactcctgcaggactggtgctgcaactactgttatatttggccttgccttgggatacaa

SEQ ID NO: 7193 - DNA, 265 bp, Glycine max
  unsure (1)...(265): unsure at all n locations
  Clone ID: 700973215H1
agtgttttgcttttgctgttgtacaagatgagtgatgagaatggcgaagaacctcgagaaaaccgtccggttccacgcttgaatgaaaggattctttcatctctgtctaggagatcagttgctgctcacccttgcatgatcttgaaattggacctggagcgcctatgattttcaattgtgttgtggagatcactaagggaagcaaggtcaaatacgaacttgacaaaaagacnggattaattaaggttgatcggattctgtactc

SEQ ID NO: 7194 - DNA, 260 bp, Glycine max
  Clone ID: 701109310H1
tttcaaagtatttgcttttattttttggtgaaaaagtgttttgcttttgctgttgtacaagatgagtgatgagaatggcgaagaacctcgagaaaaccgtccggttccacgcttgaatgaaaggattctttcatctctgtctaggagatcagttgctgctcacccttggcatgatcttgaaattggacctggagcgccttgattttcaattgtgttgtggagatcactaagggaagcaaggtcaaatacgaacttgacaa

SEQ ID NO: 7195 - DNA, 236 bp, Glycine max
  Clone ID: 700847609H1
ctttcaaagtatttgcttttattttttggtgaaaaagtgtttatgcttttgctgttgtacaagatgagtgatgagaatggcgaagaacctcgagaaaaccgtccggttccacgcttgaatgaaaggattctttcatctctgtctaggagatcagttgctgctcacccttggcatgatcttgaaattggacctggagcgcctatgattttcaattgtgttgtggagatcactaaggg

SEQ ID NO: 7196 - DNA, 249 bp, Glycine max
  Clone ID: 700952058H1
ggagcaacctctttccttttcactgagtataagtacgtgggaatcttcatggtggcttttgccattttgatattcctcttccttggctctgtggaaggattcagcacaagctaccagccttgcacctatgaccaaactaaaatgtgtaagccagctcttgccactgctgttttcagcaccatatctttcctgcttggaggtgtcacatcgcttatttctggattccttggaatgaaaattcaacttatg

SEQ ID NO: 7197 - DNA, 262 bp, Glycine max
  Clone ID: 700756103H1
ctttccttttcactgagtataagtacgtgggaatcttcatggtggctttcgccattttgatattcctcttccttggctctgtggaaggattcagcacaagctaccagcgttgcacctatgaccacactagaatgtgtaagccagctcttgccactgctgttttcaggaccatatctttcctgcttggaggtgtcacatcgcttatttctggattccttggaatgaaaattgcaacttatgccaatgcaagaaccaccctgga

SEQ ID NO: 7198 - DNA, 242 bp, Glycine max
  Clone ID: 700847173H1
atgagaacaaaatagttgatgttgaagactttctaccggctgaagctgccattgatgccatcaattactccatggacttgtatgctgcttacatagttgagagcttaaggcactaacttctttagaaactgaatagccaatttcagtgatctccaactaaatatgtaaaatgtgaatgaaactccataaacactgtgatttccgtgctgttctgtgatgcactagtgctgcctcggttattg

SEQ ID NO: 7199 - DNA, 251 bp, Glycine max
  Clone ID: 700847165H1
atgagaacaaaatagttgatgttgaagactttctaccggctgaagctgccattgatgccatcaattactccatggacttgtatgctgcttacatagttgagagcttaaggcactaacttctttagaaactgaatagccaatttcagtgatctccaactaaatatgtaaaatgtgaatgaaactccataaacattgtgatttccgtgctgttctgtgatgcactagtgctgcctcggttattgacacaacag

SEQ ID NO: 7200 - DNA, 229 bp, Glycine max
  Clone ID: 700844601H1
aagatttactatggtgatgactggggtggtctttttgaggccatcactggttatggtcttggtgggtcttctatggctttgtttggaagagttggtggaggtatctatactaaggctgctgatgttggtgctgatcttgtcggaaaggttgaaagaaacatccccgaagatgatccaagaaatccagctgtgattgctgataatgttggtgataatgttggggatatcg

SEQ ID NO: 7201 - DNA, 253 bp, Glycine max
  Clone ID: 700904602H1
gactgggtcggtctttttgaggccatcactggttatggtcttggtgggtcttctatggctttgtgtggtagagttggtcgaggtatctatactaaggctgctgatgttggtgctgatcttgtcggaaaggttgaaagagacatccccgaagatgatccaagaaatccagctttgattgctgataatgaccgtgataatgttggggatatcgctggtatgggatctgatctgtttgcggtcatatgccgagtca

SEQ ID NO: 7202 - DNA, 271 bp, Glycine max
  unsure (1)...(271): unsure at all n locations
  Clone ID: 701002118H1
cnctggttatggtcttggtgggtcttctatggctttgttnggaaganttggtggaggtatctatactaaggctgctgatgttggtgctgatcttgtcggaaaggttgaaagaaacatccccgaagatgatccaaganatccagctgtgattnctgataatgttggtgataatgttggggatatcnctggnatgggacctgatcttttgggtcnaaatgncngagtcancctgtnnctcccccttgtngtcnccnccanccttnttgggggg

SEQ ID NO: 7203 - DNA, 257 bp, Glycine max
  Clone ID: 701044831H1
ttctctgtgactgcctctgttccgccaagcgcagattttcccaccgttcaggccaccggctgagttaggtttccggcgaggatgggtgctgctctgctgtcggagcttgcgacggagatagtcgtgccagtgtgcgccgtcatcgggatcgtgttctcgctggtgcagtggttcctcgtgtcgcgcgtcaagctcactcccgaccgcaacggaacgacgtcgtcgccgcgcaacaacaaaaacggctacggcgactt

SEQ ID NO: 7204 - DNA, 236 bp, Glycine max
  Clone ID: 700891764H1
acacgttctctgtgactgcctctgttccgccaagcgcagcattgccccaccgttcaggccaccggctgagttaggtttccggcgaggatgggtgctgctctgctgtcggagcttgcgacggagatagtcgtgccagtgtgcgccgtcatcgggatcgtgttctcgctggtgcagtggttcctcgtgtcgcgcgtcaagctcactcccgaccgcaacggaacgacgtcgtcgccgcg

SEQ ID NO: 7205 - DNA, 251 bp, Glycine max
  Clone ID: 700953633H1
ctgtgactgcctctgttccgccaagcgcacattttcccaccgttcaggccaccggctgagttaggtttccggcgaggatgggtgctgctctgctgtcggagcttgcgacggagatagtcgtgccagtgtgcgccgtcatcgggatcgtgttctcgctggtgcagtggttcctcgtgtcgcgcgtcaagctcactcccgaccgcaacggaacgacgtcgtcgccgcgcaacaacaaaaacggctacggcgac

SEQ ID NO: 7206 - DNA, 247 bp, Glycine max
  Clone ID: 700753981H1
tgactgcctctgttccgccgaacccagcattttcccaccgttcgggccaccggcggagttagttttccggcaaggatgggtgctgctctgctgtctgagcttgcgacggagatagttgtgccggcctgcgccgtcatcgggatcgtgttctcgttggtgcagtggttcctcgtgtcgcgcgtcaagctcactcccgaccgaaacggaacgacgtcgtcgccgcgcaacaacaagaacggctacggcg

SEQ ID NO: 7207 - DNA, 271 bp, Glycine max
  unsure (1)...(271): unsure at all n locations
  Clone ID: 701104248H1
ctggtgactgcctctgntccgccaagcgcagatgtttcccaccgttcaggccaccggctgagttaggtttccggcgaggatgggtgctgctctgctgtcggagcttgccacggagatagtcgtgccagtgtgcgccgtcatcgggatcgtgttctcgctggtgcagtggttcctcgtgtcgcgcgtcaagctcactcccgaccgcaacggaacgacgtcgtcgccgcgcaacaacaaatacggctacggcgacttgctcattgaagaggag

SEQ ID NO: 7208 - DNA, 256 bp, Glycine max
  Clone ID: 700888545H1
ggcggttgagtctcttgtgtttgctcccttctttgctacacatggtggcctactcttcaagatctaaaggatttgatagaaaaagagtatcgtccatcatttttctacaacgacagaacaaggaaaagccgtccctttaccaatgccttctcgtttttgtgttagtctttaactcatctgtcatgtcaattccattgtttttgaaaccttttcctcccccaccttgaaacaaagtatattttgtctcatgtagttt

SEQ ID NO: 7209 - DNA, 309 bp, Glycine max
  Clone ID: 700954577H1
gaagcaccagcctcaatgtacttcttaagctcatggcggttgagtctcttgtgtttgctcccttggtttgctacacatggtggcctactcttcaagatctaaaggatttgatagaaaaagagtatcgtccatcatttttctacaacgacagaacaaggaaaagccgtccctttaccaatgccttctcgtttttgtgttagtctttaactcatctgtcatgtcaattccattgtttttgaaaccttttcctcccccaccttgaaacaaagtatattttgtctcatgtagttttaagacaattgattaggc

SEQ ID NO: 7210 - DNA, 241 bp, Glycine max
  Clone ID: 700869270H1
tcaagatctaaaggatttgatagaaaaagagtatcgtccatcatttttctacaacgacagaacaaggaaaagccgtccctttaccaatgccttctcgtttttgtgttagtctttaactcatctgtcatgtcaattccattgtttttgaaaccttttcctcccccaccttgaaacaaagtatattttgtctcatgtagttttaagacaacttgattaggctgagtctgttgcgaaaattttc

SEQ ID NO: 7211 - DNA, 184 bp, Glycine max
  Clone ID: 700792533H1
atcaattttctacaatggcagaacaaggaaaagcccgttcctttaccagtgccttctcttttttgttagtctttaactcatctgtcatgtcaattccattgtttttgaaacctttccatcccccaccttgaaacaaaagtataatttgtctcatgtagttttaagacactcgattaggctgagc

SEQ ID NO: 7212 - DNA, 227 bp, Glycine max
  Clone ID: 700734996H1
gtaaaagagtatcgtccatcatttttctacaacgacagaacaaggtttagccgtccctttaccaatgccttctcgtgtctgtgttagtctttaactcatctgtcatgtcaattccattgtttttgaaaccttttcctcccccaccttgaaacaaagtatattttgtctcatgtagttttaagacaacttgattaggctgagtctgttgcgaaaattttcctgtatga

SEQ ID NO: 7213 - DNA, 272 bp, Glycine max
  Clone ID: 701061126H1
atgaaattgaaccagctctaaaaaagcagcttatcatctctacagtactcatgactgttggaattgcaattattagttggattgctctgccaacatccttcacaattttcaactttggtgctcagaaggaagtaaagagctggcactgttcctctgtgtgggtgttggtctatgggctggacttattattgcgtttgttactgagtactatacaagcaatgcttacagtcctgtacaagatgttgctgattcctgccggactggagctgcaa

SEQ ID NO: 7214 - DNA, 251 bp, Glycine max
  Clone ID: 700962864H1
attgaaccagctctaaaaaagcagcttatcatctctacagtactcatgactgttggaattgcaattattagttggattgctctgccaacatccttcacaattttcaactttggtgctcagaaggaagtaaagagctggcagctgttcctctgtgtgggtgttggtctatgggctggacttattattgggtttgttactgagtactatacaagcaatgcttacagtcctgtacaagatgttgctgattcctg

SEQ ID NO: 7215 - DNA, 244 bp, Glycine max
  Clone ID: 700754883H1
cggaaggcttcagtactaagagccagccctgcacatatgataagagcaagctatgcaagccagcccttgcgactgcattgtttagcactgtatctttcttgcttggtgctataacttcagtcctatctggtttccttgggatgaaaattgcaacctatgccaatgcaaggacaaccttggaagccagaaagggagttggaaaggctttcattactgcatttaggtctggtgcagtgatgggttt

SEQ ID NO: 7216 - DNA, 268 bp, Glycine max
  unsure (1)...(268): unsure at all n locations
  Clone ID: 700971147H1
gagccagccctgcacatatgataagagcnagctatgcaagccagcccttgcgactgcattgtttagcactgtatctttcttgcttggtgctataacttcagtcctatctggtttccttgggatgaaaattgcaacctatgccaatgcaaggacaaccttggaagccagaaagggagttggaaaggcttcattactgatttaggtctggtgcagtgacgggtttccttcttgcagcaaatggtcttttggtgccctacattaccatcaa

SEQ ID NO: 7217 - DNA, 259 bp, Glycine max
  Clone ID: 700904547H1
caagcaatgcttacagccctgtacaagatgttgctgattcctgccggactggagctgcaaccaatgtcatctttggccttgctctgggatacaagtctgtcattattcctatttttgccatcgcaatcagcatttttgtgagttttacttttgctgcaatgtatggcattgctgtggctgcccttgggatgctgagcaccattgcgacagggttggctattgatgcctatgggccaatcagtgacaatgcaggaggtat

SEQ ID NO: 7218 - DNA, 255 bp, Glycine max
  Clone ID: 700665391H1
atgtcatctttggccttgctctgggatacaagtctgtcattattcctatttttgccattgcaatcagcatttttgtgagttttacttttgctgcaatgtatggcattgctgtggctgcccttgggatgctgagcaccattgcgacagggttggctattgatgcctatgggccaatcagtgacaatgcaggaggtattgctgagatggcaggcatgagccatcgtattcgtgagagaactgatgcccttgatgctg

SEQ ID NO: 7219 - DNA, 248 bp, Glycine max
  Clone ID: 700941185H1
cgacagggttggctattgatgcctatgggccaatcagtgacaatgcaggaggtattgctgagatggcaggcatgagccatcgtattcgtgagagaactgatgcccttgatgctgctggcaacactactgctgccataggcaagggatttgctattgggtctgctgctttggtgtctttggccctatttggtgcatttgtgagcagagctggaattttgactgttgatgtcttgactcccaaggtcttt

SEQ ID NO: 7220 - DNA, 241 bp, Glycine max
  unsure (1)...(241): unsure at all n locations
  Clone ID: 700660695H1
ctgcaatgtatggcattgctgtggctgcccttgggatgctgagnaccattgcgacagggttggctattgatgcctatgggccaatcagtgacaatgcaggaggtattgctgagatggcaggcatgagccatcgtattcgtgagagaactgatgcccttgatgctgctggcaacactactgncgccataggcaagggatttgctattgggtctgccgctctgtctcggccctatttggtgca

SEQ ID NO: 7221 - DNA, 265 bp, Glycine max
  Clone ID: 701127185H1
caatgtatggcattgctgtggctgcccttgggatgctgagcaccattgcgacagggttggcgattgatgcctatgggccaatcagtgacaatgcaggaggtattgctgagatggcaggcatgagccatcgtattcgtgagagaactgatgcccttgtgctgctggcaacactactgctgccataggcaagggatttgctattgggtctgctgctttggtgtctttggccctatttggtgcatttgtgagcagagctggaattttg

SEQ ID NO: 7222 - DNA, 272 bp, Glycine max
  Clone ID: 701209525H1
cttctctgtttttctaactctcttcaaaccttattcttccaagtccatggaaacatcattttcccttgctaggtggcttattgtgtgttattctgttttagggatttgccattggttctgctgcccttgtatcactggccctctttggtgcctttgtgagccgagctgctattacaactgttgatgtgttgactccaaaggttttcattggtttgattgtgggtgcatgcttccttactggttcctgcatgactatgagagtgtgggagtgc

SEQ ID NO: 7223 - DNA, 242 bp, Glycine max
  Clone ID: 701213556H1
tctccaaacctaattcttctctgtttttctaactctcttcaaaccttattcttccaagtccatggaaacatcattttcccttgctaggtggctattgtgtgttattctgttttagggatttgccattggttctgctgcccttgtatcactggccctctttggtgcctttgtgagccgagctgctattacaactgttgatgtgttgactccaaaggttttcattggtttgattgtgggtgcaa

SEQ ID NO: 7224 - DNA, 189 bp, Glycine max
  unsure (1)...(189): unsure at all n locations
  Clone ID: 700668618H1
aatatncacaaaggccgctgatgttggagcagaccttgtcggaaaagtagaacanggaatacctgaagacgaccctaggaatcctgctgttattgctgntctggttggtgacaatgttnggagattgtgctgctcgaggtgctgatcnttttgnaagtatgcagctgaaataattagtgccatgatact

SEQ ID NO: 7225 - DNA, 232 bp, Glycine max
  unsure (1)...(232): unsure at all n locations
  Clone ID: 700797861H1
tcacccctggcacgacttagagattgggccaggagctccagcagttttcaactgtgtggttgaaattggcaaaggaagtaaggttaagtatgagctggacaagacaagtggacttataaaggttgatcgtattctttactcatcagtagtctacccacacaactaacgatattnnccaanaaccatttgtgaagacagtgatcctatggacgtgctggttctaatgcaggaa

SEQ ID NO: 7226 - DNA, 266 bp, Glycine max
  Clone ID: 700944850H1
ctcaccttgaagattcaagtgcatggaattcgagtatacctcaccctaagctcaatgaaagaattctgtcttctctgtcacggagaactgttgctgctcacccctggcacgatttagagattgggccaggagctccagctgttttcaactgtgtggttgaaattggcaaaggcagtaaggttaagtatgagctggacaagacaagtggacttataaaggttgatcgtattctttactcatcagttgtctacccacacaactatggt

SEQ ID NO: 7227 - DNA, 290 bp, Glycine max
  Clone ID: 701056207H1
agtttctcttatctctaagtcaacatggctcaccatgaagattcaagtgtatggaattcgagtatacctcaccctaagctcaatgaaagaattttgtcttctctgtcacggagaactgttgctgctcacccctggcacgatttagagattgggccaggagctccagctgttttcaactgtgtggttgaaattggcaaaggcagtaaggttaagtatgagctggacaagacaagtggacttataaaggttgatcgattctgtactcatcagttgtctacccacacaactat

SEQ ID NO: 7228 - DNA, 296 bp, Glycine max
  unsure (1)...(296): unsure at all n locations
  Clone ID: 700605115H2
ctccgactcnttctcttaatcccnaaagtcaacatgggctcaccttggaagatncaagtggcatgggaattcgagtatacctcaccctaagctncaatgaaagaattctgtcttctctgtcacggagaactgttgctgctcacccctggcacgatttagagattggggccaggagctccagctgttttcaactgtgtggttgaaattggcaaaggcagtaaggttaagtatgagctggacaagacaagtggacttataaaggntgatcgtattctttactcatcagttgtctaccc

SEQ ID NO: 7229 - DNA, 259 bp, Glycine max
  Clone ID: 700897063H1
ctttctcttatctctaagtcaacatggctcaccttgaagattcaagtgcatggaattcgagtatacctcaccctaagctcaatgaaagaattctgtcttctctgtcacggagaactgttgctgctcacccctggcacgatttagagattgggccaggagctccagctgttttcaactgtgtggttgaaattggcaaaggcagtaaggttaagtatgagctggacaagacaagtggacttataaaggttgatcgtattct

SEQ ID NO: 7230 - DNA, 287 bp, Glycine max
  Clone ID: 700561829H1
tttcgcactttctttcagtcaccatctccgactctttctcttatctctaagtcaacatggctcaccttgaagattcaagtgcatggaattcgagtatacctcaccctaagctcaatgaaagaattctgtcttctctgtcacggagaactgttgctgctcacccctggcacgatttagagattgggccaggagctccagctgttttcaactgtgtggttgaaattggcaaaggcagtaaggttaagtatgagctggacaagacaagtggacttataaaggttgatcgt

SEQ ID NO: 7231 - DNA, 281 bp, Glycine max
  Clone ID: 701204883H1
ctttcactcaccagtcaccacctctgaactctctctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtggttgaaattggcaaaggaagtaaggttaagtatgagctggacaagacaagtggacttataaaggttgat

SEQ ID NO: 7232 - DNA, 242 bp, Glycine max
  Clone ID: 700754984H1
ctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtggttgaaattggcaaaggaagtaaggttaagtatgagctggacaagacaagtggacttataaagg

SEQ ID NO: 7233 - DNA, 255 bp, Glycine max
  Clone ID: 700854552H1
tccgactctttctcttatctctaagtcaacatggctcaccatgaagattcaagtgtatggtattcgagtatacctcaccctaagctcaatgaaagaattttgtcttctctgtcacggagaactgttgctgctcacccctggcacgatttagagattgggccaggagctccagctgttttcaactgtgtggttgaaattggcaaaggcagtaaggttaagtatgagctggacaagacaagtggacttataaaggtt

SEQ ID NO: 7234 - DNA, 246 bp, Glycine max
  Clone ID: 700873337H1
tctgaactctctctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtggttgaaattggcaaaggaagtaaggttaagtatgagctggacaagacaagtggact

SEQ ID NO: 7235 - DNA, 246 bp, Glycine max; identical to SEQ ID NO: 7234
  Clone ID: 700873349H1

SEQ ID NO: 7236 - DNA, 266 bp, Glycine max
  Clone ID: 700952403H1
ctcaccagtcaccacctctgaactctctctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtgggttgaaattggcaaaggaagtaaggttaagtatgagctggacaagacaagtggacttat

SEQ ID NO: 7237 - DNA, 248 bp, Glycine max
  unsure (1)...(248): unsure at all n locations
  Clone ID: 700846561H1
cagtcaccacctctgaactctctctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtggttgaaattggcaaaggaagtaaggttaagtatgagnctgacaagac

SEQ ID NO: 7238 - DNA, 242 bp, Glycine max
  Clone ID: 700953987H1
ccagtcaccacctctgaactctctctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtggttgaaattggcaaaggaagtaaggttaagtatgagctgg

SEQ ID NO: 7239 - DNA, 246 bp, Glycine max
  unsure (1)...(246): unsure at all n locations
  Clone ID: 700568667H1
tncgactctttctcttatctctaagtcaacatggctcaccttgaagattcaantgcatggnattcgagtatacctcaccctaagctcaatgaaagaattctgtcttctctgtcacggagaactgttgctgctcacccctggcacgatttgagattgggccaggagctccagctgttttcaactgtgtggttgaaattggcaaaggcagtaaggttangtatgagctggacagacaagnggattata

SEQ ID NO: 7240 - DNA, 249 bp, Glycine max
  Clone ID: 700895231H1
gtcaccacctctgaactctctctctcatctataagtcaacatggctcatcatgaagattcaagtgcatggaattcgagtaaacctcaccctaagctcaatgaaagaattctgtcttctctgtcacggagaactgttgctgctcacccctggcacgacttagagattgggccaggagctccagcagttttcaactgtgtggttgaaattggcaaaggaataacgtaagtatgagctggcagacaagtgga

SEQ ID NO: 7241 - DNA, 196 bp, Glycine max
  Clone ID: 701101791H1
ctgaactctctctctcatctataagtcaacatggctcatcatgaagcattcaagtgcatcgaattcgagtagacctcaccctaagctcaatgaaagaattctgtcatctctgtcacggagaactgttgctgctcacccctggcacgacttagagattgggccaggagttccagcagttttcaactgtgtggttgaa

SEQ ID NO: 7242 - DNA, 260 bp, Glycine max
  Clone ID: 701011114H1
ctgtgctgctcttgttgttgcttccatctcttcttttggggtgaatcatgagttgactgctatgttataccctctcattatcagttctgtgggtatccttgtttgtttgctcacaaccttatttgcaactgacttctttgagatcaaggctgtaaaggagattgagcctgcattgaagaaacaactcatcatttccactgccctgatgacttttgggattgcaattgttagttggattgcactcccaacttccttcacta

SEQ ID NO: 7243 - DNA, 237 bp, Glycine max
  Clone ID: 700674046H1
tgccgagtcatcctgtgctgctcttgttgttgcttccatctcttcttttggggtgaatcatgagttgactgctatgttataccctctcattatcagttctgtgggtatccttgtttgtttgctcacaaccttatttgcaactgacttctttgagatcaaggctgtaaaggagattgagcctgcattgaagaaacaactcatcatttccactgccctgatgactattgggattgcaat

SEQ ID NO: 7244 - DNA, 254 bp, Glycine max
  Clone ID: 700967038H1
tctcgagccgaatcggctcgaggttgaaagaaacatccccgaagatgatccaagaaatccaactgtgattgctgataatgatggtgataatgttggggatatcgctggtatgggatctgatctttttggttcatatgccgagtcatcctgtgctgctcttgttgttgcttccatctcttcttttggggtgaatcatgagttgactgctatgttataccctctcattatcagttctgtgggtatccttgtatgtt

SEQ ID NO: 7245 - DNA, 220 bp, Glycine max
  Clone ID: 700740792H1
gccgagtcatcctgtgctgctcttgttgttgcttccatctcttcttttggggtgaatcatgagttgactgctatgttataccctctaattatcagttctgtgggtatccttgtttgtttgctcacaactttatttgcaactgacttctttgagatcaaggctgtaaaggagattgagcctgcattgaagaaacagctcatcatttccactgccttgatga

SEQ ID NO: 7246 - DNA, 237 bp, Glycine max
  unsure (1)...(237): unsure at all n locations
  Clone ID: 700872817H1
ctctttttnatnngttggatgatccatgaaatccagctgtgattgctgataatgttggtgataatgttggtgatatcgctggtatgggatctgatctttttggttcatatgccgagtcatcctgtgctgctcttgttgttgcttccatctcttcttttggggtgaatcatgagttgactgctatgttataccctctaattatcagttctgtgggtatccttgtttgtttgctcacaa

SEQ ID NO: 7247 - DNA, 108 bp, Glycine max
  Clone ID: 700738286H1
gccgagtcatcctgtgctgctcttgttgttgcttccatctcttcttttggggtgaatcatgagttgactgctaggttataccctctaattatcagttctgtgggtatc

SEQ ID NO: 7248 - DNA, 304 bp, Glycine max
  Clone ID: 700566516H1
gaagaagtacgcaggcaattcaacaccattccagggttgatggagggaactgctaagcctgactatgccacatgtgttaagatctccactgatgcttccattaaagaaatgattccacctggtgctcttgtcatgcttacaccgcttgttgttggaatcctttttggtgttgaaacactttctggtgtcctagctggatctttggtgtctggtgtacagattgctatttctgcatccaacaccggtggtgcttgggataatgccaagaagtacattgaggctggtgcttctgagcatgcaagaa

SEQ ID NO: 7249 - DNA, 272 bp, Glycine max
  unsure (1)...(272): unsure at all n locations
  Clone ID: 700978728H1
cgactccaaaggttttcattggtttgattgtgggtgcaatgcttccttactggttttctgctatgactatcgnagagtgtgggaagtgctgctctgaagatggttgaagaagtacgcaggcaattcaacaccattccagggttgatggagggaactgctaagcctgactatgccacatgtgttaagatctccactgatgcttccattaaagaaatgattccacctggtgctcttgtcatgcttacaccgcttgttgttggaatcctttttgg

SEQ ID NO: 7250 - DNA, 257 bp, Glycine max
  Clone ID: 700907549H1
ctggttttctgctatgactatgaagagtgtgggaagtgctgctctgaagatggttgaagaagtacgcaggcaattcaacaccattccagggttgatggagggaactgctaagcctgactatgccacatgtgttaagatctccactgatgcttccattaaagaaatgattccacctggtgctcttgtcatgcttacaccgcttgttgttggaatcctttttggtgttgaaacactttctggtgtcctagctggatctt

SEQ ID NO: 7251 - DNA, 268 bp, Glycine max
  Clone ID: 700908149H1
ctgccggaaacacgactgccgctattgggaagggatttgccattggttctgctgcccttgtatcactggccctctttggtgcctttgtgagccgagctgctattacaactgttgatgtgttgactccaaaggttttcattggtttgattgtgggtgcaatgcttccttactggttttctgctatgactatgaagagtgtgggaagtgctgctctgaagatggttgaagaagtacgcaggcaattcaacaccattccagggttgatgga

SEQ ID NO: 7252 - DNA, 290 bp, Glycine max
  unsure (1)...(290): unsure at all n locations
  Clone ID: 700559351H1
atttttgttagtttcacctttgctgccatgtatggtattgctgttgctngcgcttggcatgctgagtaccattgccaccggattggccattgatgcatatggtccaatcagtgacaatgctggaggttntgctgaaatggctggtatgagtcacagaattagagagagaactgatgcccttgatgctgccggaaacacgactgccgctattgggaagggatttgccattggttctgctgcccttgtatcactggccctctttggtgcctttgtgagccgagctgctatta

SEQ ID NO: 7253 - DNA, 255 bp, Glycine max
  Clone ID: 700898914H1
ctctggccctctttggtgcctttgtgagccgagctgctattacaactgttgatgtgttgactccaaaggttttcattggtttgattgtgggtgcaatgcttccttactggttttctgccatgactatgaagagtgtgggaagtgctgctctgaagatggttgaggaagtacgcaggcaattcaacaccattccaggattgatggagggaactgctaagcctgactacgccacttgtgttaagatctccactgatg

SEQ ID NO: 7254 - DNA, 264 bp, Glycine max
  Clone ID: 700946269H1
tgccgttgctgcacttggcatgctgagtaccattgccaccggattggccattgatgcatatggtccaatcagtgacaatgctggaggtattgctgagatggccggtatgagtcacagaattagagagagaactgatgcccttgatgctgccggaaacacaactgccgcaattgggaagggatttgccatcggttctgctgcccttgtatctctggccctctttggtgcctttgtgagccgagctgctattacaactgttgatgt

SEQ ID NO: 7255 - DNA, 258 bp, Glycine max
  Clone ID: 701011513H1
catcagtgacaatgctggaggtattgctgaaatggctggtatgagtcacagaattagagagagaactgatgcccttgatgctgccggaaacacgactgccgctattgggaagggatttgccattggttctgctgcccttgtatcactggccctctttggtgcctttgtgagccgagctgctattacaactgttgatgtgttgactccaaaggttttcattggtttgattgtgggtgcaatgcttccttactggttttc

SEQ ID NO: 7256 - DNA, 255 bp, Glycine max
  Clone ID: 700785951H2
gaactgatgcccttgatgctgccggaaacacgactgccgctattgggaagggatttgccattggttctgctgcccttgtatcactggccctctttggtgcctttgtgagccgagctgctattacaactgttgatgtgttgactccaaaggttttcattggtttgattgtgggtgcaatgcttccttactggttttctgctatgactatgaagagtgtgggaagtgctgctctgaagatggttgaagaagtacgca

SEQ ID NO: 7257 - DNA, 251 bp, Glycine max
  Clone ID: 701003561H1
ggatctttggtgtctggtgtacagattgctatttctgcatccaacaccggtggtgcttgggataatgccaagaagtacattgaggctggtgcttctgagcatgcaagacgccttggtccaaaagggtcagattgtcacaaggcagctgttattggtgacaccattggagaccctctaaaggatacatctggaccttcacttaacatccttattaagctcatggcggttgagtctcttgtgtttgctccctt

SEQ ID NO: 7258 - DNA, 248 bp, Glycine max
  Clone ID: 700755340H1
cctttgtgagccgagctgctattacaactgttgatgtgttgactccaaaggttttcattggattgattgtgggtgcaatgcttccttactggttttctgccatgaccatgaagagtgtgggaagtgctgctctgaagatggttgaggaagtacgcaggcaattcaacaccattccaggattgatggagggaactgctaagcctgactacgccacttgtgttaagatctccactgatgcttccattaaa

SEQ ID NO: 7259 - DNA, 248 bp, Glycine max
  Clone ID: 700756774H1
tgttgatgtgttgactcctaaggttttcattggtttgattgtgggtgcaatgcttccttactggttttctgctatgactatgaagagtgtgggaagtgctgctctgaagatggttgaagaagtacgcaggcaattcaacaccattccagggttgatggagggaactgctaagcctgactatgccacatgtgttaagatctccactgatgcttcattaaagaaatgattccacctggtgctcttgtcat

SEQ ID NO: 7260 - DNA, 305 bp, Glycine max
  unsure (1)...(305): unsure at all n locations
  Clone ID: 700564820H1
tggtattgctgtngctgcgcttgnccatgctgagtaccattgccaccgganttggccattgatgcatatggtccaatcagtgacaatgctggaggtattgctgaaatggctggtatgagtcacagaattagagagagaactgatgcccttgatgctgccggaaacacgactgccgctatngggaagggatttgccnctggttctgctgcccttgtatcactggccctctttggtgcctttgtgagccgagctgctattacaactgttgatgtgttgactccaaagttttcattggtttgattgtg

SEQ ID NO: 7261 - DNA, 230 bp, Glycine max
  Clone ID: 700902381H1
cactgatgcttccattaaagaaatgattccacctggtgctcttgtcatgcttacaccccttgttgttggaatcctttttggtgtcgaaacactttctggtgtcctagctggatctttggtgtctggtgtacagattgctatctctgcatccaacaccggtggtgcttgggataatgccaagaagtacattgaggctggtgcttctgagcatgcaaggagccttggtccaa

SEQ ID NO: 7262 - DNA, 285 bp, Glycine max
  unsure (1)...(285): unsure at all n locations
  Clone ID: 700970334H1
gtacattgaggctggtgcttctgagcatgcaaggngccttggtccaaaagggtcagattgtcacaaggcagctgttattggtgacaccattggagaccccctcaaggatacatcagggccttcacttaacatccttatcaagctcatggccgttgagtctcttgtgtttgctcccttctttgcgacacatggtggcctactcttcaagatctaaaggatttaatagaaaaaagagcatcgtccatcattttctacaatggcagaacaaggaaaaccccgtttttt

SEQ ID NO: 7263 - DNA, 247 bp, Glycine max
  unsure (1)...(247): unsure at all n locations
  Clone ID: 700656490H1
gtgtacagattgctatctctggcatccaacancggtggtgcttgggataatgccaagaagtacattgaggctggtgcttctgagcatgcaaggnaccttggtccaaaagggtcagnttgtcacaaggcagctgttattggtgacaccattggagaccccctcaaggatacatcagggccttcacttaacatccttatcaagctcatggccgttgagtctcttgtgtttgctcccttctttgcganac

SEQ ID NO: 7264 - DNA, 237 bp, Glycine max
  Clone ID: 700871681H1
cggtatgatgttatttctgcatccaacactggtggttcttgggataatgccaagaagtacattgaggctggtgcttctgagcatgcaagaagccttggtccaaaagggtcagattgtcacaaggcagctgttattggtgacaccattggagaccctctaaaggatacatctggaccttcacttaacatccttattaagctcatggcggttgagtctcttgtgtttgctcccttcttt

SEQ ID NO: 7265 - DNA, 216 bp, Glycine max
  unsure (1)...(216): unsure at all n locations
  Clone ID: 701153255H1
gcaattgggaaggnatttgccatcggttctgcngcccttgtatctctggccctctttggtgcctttgtgagccgagctgctattacaactgttgatgtgttgactccaancgttttcattggtttgattgtgggtgcaatgcttccttactggttttctgccatgaccatgagagtgtgggaagtgctgctctgaagatggttgaggaatacnnag

SEQ ID NO: 7266 - DNA, 267 bp, Glycine max
  Clone ID: 701049483H1
attaggctggtgcttctgagcatgcaagaagccttggtccaaaagggtcagattgtcacaaggcagctgttattggtgacaccattggagaacctctaaaggctacatctggaccttcacttaacatccttattaagctcatggcggttgagtctcttgtgtttgctcccttctttgctacacatggtggcctactcttcaagatctaaaggatttgatagaaaaagagtatcgtccatcatttttctacaacgacagaacaaggaa

SEQ ID NO: 7267 - DNA, 219 bp, Glycine max
  Clone ID: 700796611H1
gggatttgccatcggttcttctgcccttgtatctctggccctctttggtgcctttgtgagccgagctgcttttacaactgttgatgtgttgactccaaaggttttcattggtttgattgtgggtgcaatgcttccttactggttttctgctcatgaccatgaagtgtgtgggaagtgctgctctgaagatggttgaggacgtacgcaggcaattcaaca

SEQ ID NO: 7268 - DNA, 227 bp, Glycine max
  Clone ID: 700863103H1
gccggaaacacgagtgacgctattgggaaaggatttgccaatgggtctgctgccctgtatcatggcctctttggtgcctttgtgagccgagctgctattacaactgttgatgtgttgactccaaaggttttcattggtttgattgtgggtgcaatgcttccttactggttttctgctatgactatgaagagtgtgggaagtgctgctctgaagatggttgaagaagt

SEQ ID NO: 7269 - DNA, 260 bp, Glycine max
  Clone ID: 700795148H1
gctgttggtctttgggcaggtcttattattggatttgtaactgagtactatactagcaatgcatatagttaggtgcaagatgttgcagactcctgcaggactggtgctgcaactaatgttatatttggccttgccttgggatacaagtctgttattattccaatcttttgctattgccattagtatttttgttagtttcacctttgctgccatgtatggtattgctgttgctgcgcttggcatgctgagtaccattgcca

SEQ ID NO: 7270 - DNA, 211 bp, Glycine max
  Clone ID: 701099340H1
ccttgatgctgccggaaacacgactgccgctattgggaacggacttgccattggttctgctgcccttgtatcactggccctctgtggtgcctttgtgagccgagctgctattacaactgttgatgtcgttgactccaaaggttttcattggtttgattgtgggtgcaatgcttccttactggttgtctgctatgactatgaagagtgtcgg

SEQ ID NO: 7271 - DNA, 145 bp, Glycine max
  Clone ID: 701097793H1
caatattccaatttttgctattgcaattagtatttttgttagtttcacctttgctgccatgtatggtatagctgttgctgcgcttggcatgctgagtaccattgccaccggattggccattgatgcatatggtccaatcagtgac

SEQ ID NO: 7272 - DNA, 286 bp, Glycine max
  Clone ID: 701049119H1
ctcggcaccgagattttgattccggtctgcgccatcattggaatagggttcgccctcttccagtgggtcctcgtctccaaggttaagctctccgctgccagagacgcttcccctaacgccgccggcaaaaatggctacaacgattacctcatcgaagaagaggaaggcctcaacgatcacaacgttgtcctcaaatgcgccgaaatccaaaacgccatttccgaagagcaacctctttccttttcactgaatacaagtatgtgggaatcttcatggtggcttttgc

SEQ ID NO: 7273 - DNA, 251 bp, Glycine max
  Clone ID: 701135152H1
tggaatagcgttcgccctcttccagtgggtcctcgtctctaaggtcaagctctccgctgccagagacgcttcctccaacgccggcggggcaaaaatggctacaacgattacctcatcgaagaagaggaaggcctcaacgaccacaacgtcgtcctcaaatgcgccgaaatccaaaacgccatttccgaaggagcaacctctttccttttcactgagtataagtacgtgggaatcttcatggtggcttttgc

SEQ ID NO: 7274 - DNA, 287 bp, Glycine max
  unsure (1)...(287): unsure at all n locations
  Clone ID: 701001376H1
gggagcagtgattctcccagatctcggcaccgagattttgattcccgtctgcgccatcattggaatagcgttcggcctcttccagtgggtctcgtctctaaggtcaagctctccgctgccagagacgcttcctccaacgccggcggcnccaaaaatggctacaacgattacctcatcgaagaagaggaaggcctcaacgaccacaacgtcgtcctcaaatgcgccgaaatccaaaacgccatttccgaaggagcaacctctttccttttcactgagtataagtacgt

SEQ ID NO: 7275 - DNA, 262 bp, Glycine max
  Clone ID: 701011545H1
cctctcttcactttcactctctctctctctcagccatcatcatgggagcagtgattctcccagatctcggcaccgagattttgattccggtctgcgccatcattggaatagggttcgccctcttccagtgggtcctcgtcttcaaggttaagctctccgctgccagagacgcttcccctaacgccgccggcaaaaatggctacaacgattacctcatcgaagaagaggaaggcctcaacgatcacaacgttgtcctcaaatg

SEQ ID NO: 7276 - DNA, 266 bp, Glycine max
  Clone ID: 700738622H1
ttcttatttttttcctctcttcactttcactctctctctctctctcagccatcatcatgggagcagtgattctcccagatctcggcaccgagattttgattccggtctgcgccatcattggaatagggttcgccctcttccagtgggtcctcgtctccaaggttaagctctccgctgccagagacgcttcccctaacgccgccggcaaaaatggctacgacgattacctcatcgaagaagaggaaggcctcaacgatcacaacgtt

SEQ ID NO: 7277 - DNA, 267 bp, Glycine max
  Clone ID: 700844506H1
cttatttttctcctctcttcactttcactctctctctctctctcagccatcatcatgggagcagtgattctcccagatctcggcaccgagattttgattccggtctgcgccatcattggaatagggttcgccctcttccagtgggtcctcgtctccaaggttaagctctccgctgccagagacgcttcccctaacgccgccggcaaaaatggctacaacgattacctcatcgaagaagaggaaggcctcaacgatcacaacgttgtc

SEQ ID NO: 7278 - DNA, 219 bp, Glycine max
  unsure (1)...(219): unsure at all n locations
  Clone ID: 700547904H1
agccatcatcatgggagcagtgattctcccagatctcggcaccgagattttgattccggtctgcgccatcattggaatagggttcgccctcttccagtgggtcctcgtctccaaggttaagctctccgctgccagagacgcttcccctaacgccgccggcaaaaatggctacaacgattacctcatcgnagaagaggaaggcctcaacgatcacnacgt

SEQ ID NO: 7279 - DNA, 258 bp, Glycine max
  Clone ID: 701136362H1
cctctcttcactttcactctctctctctctctcagccatcatcatgggagcagtgattctcccagatctcggcaccgagattttgattccggtctgcgtcatcattggaatagggttcgccctcttccagtgggtcctcgtctccaaggttaagctctccgctgccagagacgcttcccctaacgccgccggcaaaaatggctacaacgattacctcatcgaagaagaggaaggccttttcgatcacaacgttgtcct

SEQ ID NO: 7280 - DNA, 273 bp, Glycine max
  Clone ID: 700794050H1
cctcattcttatttttctcctctcttcactttcactctctctctctactccagccatcatcatcctagcagtgattctcccagatctcggcaccgagattttgattccggtctgcgccatcattggaatagggttcgccctcttccagtgggtcctcgtctccaaggttaagctctccgctgccagagacgcttcccctaacgccgccggcaaataatggctacaacgatgatctcatcggagaagaggaaggcctcatcgatcacgacgttg

SEQ ID NO: 7281 - DNA, 255 bp, Glycine max
  Clone ID: 700952580H1
ttcttatttttttcctctcttcactttcactctctctctctctctcagccatcatcatgggagcagtgattctcccagatctcggcaccgagattttgattccggtctgcgccatcattggaatagggttcgccctcttccagtgggtcctcgtctccaaggttaagctctccgctgccagagacgcttcccctaacgccgccggcaaaaatggctacaacgattacctcatcgaagaagaggaaggcctcaacg

SEQ ID NO: 7282 - DNA, 300 bp, Glycine max
  unsure (1)...(300): unsure at all n locations
  Clone ID: 700563827H1
ttattgtnttcctctcttcactgtcacncctctcnctgntctctngnccatnatcaggggancagtgatgctcccagatctnctgcnccgagattnngattccggtctgcgccatcagtggnatagggttcgcnctcttccagtgggtcctcttctccaaggntaanntctccgctgccaganacgcttcccctaacgccgncggcaaaaatggctacnangantacctcatcgaagaagaggaaggcctcaacnatcacaacgttgtcctcanatgcgccgaaatccaaaangccattt

SEQ ID NO: 7283 - DNA, 258 bp, Glycine max
  Clone ID: 700952567H1
cctcattcttatttttttcctctcttcactttcactctctctctctctctcagccatcatcatgggagcagtgattctcccagatctcggcaccgagattttgattccggtctgcgccatcattggaatagggttcgccctcttccagtgggtcctcgtctccaaggttaagctctccgctgccagagacgcttcccctaacgccgccggcaaaaatggctacaacgattacctcatcgaagaagaggaaggcctcaa

SEQ ID NO: 7284 - DNA, 238 bp, Glycine max
  Clone ID: 700953831H1
cttatttttttcctctcttcactttcactctctctctctctctcagccatcatcatgggagcagtgattctcccagatctcggcaccgagattttgattccggtctgcgccatcattggaatagggttcgccctcttccagtgggtcctcgtctccaaggttaagctctccgctgccagagacgcttcccctaacgccgccggcaaaaatggctacaacgattacctcatcgaagaag

SEQ ID NO: 7285 - DNA, 258 bp, Glycine max
  Clone ID: 700749982H1
cattcttatttgtttcctctcttcactttcactctctctctctctctcagccatcatcatgggagcagtgattctcccagatctcggcaccgagattttgattccggtctgcgccatcattggaatagggttcgccctcttccagtgggtcttcgtctccaaggttaagctctccgctgcagagacgcttcccctaacgccgccggcaaaaatggctacaacgattacctcatcgaagaagaggaaggcctcaacgat

SEQ ID NO: 7286 - DNA, 265 bp, Glycine max
  Clone ID: 700686154H1
ttccttccctcattcttatttttttcctctcttcactttcactctctctctctctctcagccatcatcatgggatcagtgattctcccagatctcggcaccgagattttgattccggtctgcgccatcattggaatagggttcgccctcttccagtgggtcctcgtctccaaggttaagctctccgctgccatagacgcttcccctaacgccgccggcaaaaatggctacaacgattacctcatcgaagaagaggaaggcctcaa

SEQ ID NO: 7287 - DNA, 248 bp, Glycine max
  Clone ID: 700904783H1
tccctcattcttatttttttgctgtcttcactttcactctgtctgtgtctctcagccatcatcatgggagcagtgattctcccagatctcggcaccgagattttgattccggtctgcgccatcattggaataggttcgccctcttccagtgggtcctcgtctccaaggttaagctctccgctgccagagacgcttcccctaacgccgccggcaaaaatggctacaacgattacctcatcgaagaagag

SEQ ID NO: 7288 - DNA, 238 bp, Glycine max
  Clone ID: 700952870H1
ttccctcattcttatttttttcctctcttcactttcactctctctctctctctcagccatcatcatgggagcagtgattctcccagatctcggcaccgagattttgattccggtctgcgccatcattggaatagggttcgccctcttccagtgggtcctcgtctccaaggttaagctctccgctgccagagacgcttcccctaacgccgccggcaaaaatggctacaacgattacctc

SEQ ID NO: 7289 - DNA, 232 bp, Glycine max
  Clone ID: 700961948H1
caatcttatttctatccacacttcacattcactctatctctctctctcagccatcctcatgggaacagtgaacatcccagatctcggcaccgagattttgattccagtctgcgccatcattggaatagggttcgccctcttccagtgggtcctcgtctccaaggttaagctctccgctgccagagacgcttcccctaacgccgccggcaaaaatggctacaacgattacctc

SEQ ID NO: 7290 - DNA, 279 bp, Glycine max
  Clone ID: 701210118H1
ctcattcttatttttatcctctcttcattttcactctctctctctctctcagccatcatcatgggagcagtgattctcccagatctcggcaccgagattttgattccggtctgcgccatcattggaatagggttcgccctcttccagtgggtcctcgtctccaaggttaagctctccgctgccagattagcttcccctaacgccgccggcaaaaatggctacaacgattacctcatcgaagaagaggaaggcctcaacgatcacaacgttgtcctcaaa

SEQ ID NO: 7291 - DNA, 253 bp, Glycine max
  Clone ID: 700906779H1
attccttccctcattcttatttttttcgtctcttcactttcactctctctctctctctcagtcatcatcatgggagcagtgattctcccagatctcggcaccgagattttgattccggtctgcgccatcattggaatagggttcgccctcttccagtgggtcctcgtctccaaggttaagctctccgctgccagagacgcttccactaacgcctccggcaaaaatggctacaacgattacctcatcgaagaag

SEQ ID NO: 7292 - DNA, 238 bp, Glycine max
  Clone ID: 700833390H1
cttcccttccctctcttcactatcactctctctctctctccatctctctcatccatcatgggagcagtgattctcccagatctcggcaccgagattttgattcccgtctgcgccatcattggaatagcgttcgccctcttccagtgggtcctcgtctctaaggtcaagctctccgctgcgagagacgcttcctccaacgccggcggcggcaaaaatggctacaacgattacctcatcg

SEQ ID NO: 7293 - DNA, 175 bp, Glycine max
  unsure (1)...(175): unsure at all n locations
  Clone ID: 700990989H1
agccatcatcatgggagcagtgattctcccagatctcggcaccgagattttgattccggtctgcgccatcattggaatagggttcgccctcttccagtgggtcctcgtctccaaggttaagctctccgctgccagagangcttcccnnaacgnggcgnnannaanggtacatcnt

SEQ ID NO: 7294 - DNA, 178 bp, Glycine max
  Clone ID: 701103017H1
ctcattcttatttctctcctctcttcactttcactctctctctctctctcagccatcatcatgggagcagtgattctcccagatctcggcaccgagattttgattccggtctgcgacatcattggaatagggttcgccctcttccagtgggtcctcgtctccaaggttaagctctccg

SEQ ID NO: 7295 - DNA, 276 bp, Glycine max
  unsure (1)...(276): unsure at all n locations
  Clone ID: 700978736H1
tccttncctcatnctnatttttntcctctctncanttncactctntcnntctctnagncatnatcangggagnagtgattctcncagatctcggcnccgagattttgattccggtttgcgncatcattggaatagggttcgccntctncnagtgggtcctcgnctccaaggtaaagctctccgctgccagagaacgtttcccctaangcngcgggnaaaaatggnctacaacgattacctcatggaacaanagganggctncaaggntcacaatgt

SEQ ID NO: 7296 - DNA, 256 bp, Glycine max
  Clone ID: 700795920H1
caacgattacctcatcgaagaagaggaaggcctcaacgatcacaacgttgtcctcaaatgcgccgaaatccaaaacgccatttccgaaggagcaacctctttccttttcactgaatacaagtatgtgggaatcttcatggtggcttttgccattttgatattcctattccttggctctgtggaaggattcagcacgagctaccagccttgcacctatgatcaaactaaaatgtgtaagccagctcttgctactgct

SEQ ID NO: 7297 - DNA, 244 bp, Glycine max
  Clone ID: 700888375H1
gaaggcctcaacgaccacaacgtcgtcctcaaatgcgccgaaatccataacgccatttccgaaggagcaacctctttccttttcactgagtataagtacgtgggaatcttcatggtggcttttgccattttgatattcctcttccttggctctgtggaaggattcagcacaagctaccagccctgcacctatgaccaaactaaaatgtgtaagccagctcttgccactgctgttttcagcacca

SEQ ID NO: 7298 - DNA, 227 bp, Glycine max
  Clone ID: 701121224H1
ccaagacgagcttcaccttgcgccgaaggccacagatggttgaaaccgatatggatgccgaaactgttgcaaatgtggttccaccaaaggagactcctcacagtgttcccatctcttatcattcctcacactcacacccttctcttaatgagaggattatttcatccatgaccagaagatctgttgctgcacacccgtggcacgaccttgagatagggcctggtgct

SEQ ID NO: 7299 - DNA, 253 bp, Glycine max
  Clone ID: 700743066H1
gaacaatagtagcaagcagagccccaagacgagcttcaccttgcgccgaagggccacagatggttgaaaccgatatggatgccgaaactgttgcaaatgtggttccaccaaaggagactccaaacatgttcccatctcttatcattcctcacactcacaccctcctcttaatgagagattatttcatccatgaccagaagatctgttgctgcacacccgtggcacgaccttgagatagggcctggtgctccaa

SEQ ID NO: 7300 - DNA, 276 bp, Glycine max
  Clone ID: 701005139H1
gtcgaaatagggaaaggaagcaaggtgaaatatgaacttgacaaaagaactggacttattatggttgatcgtatactttactcatcagttgtttatcctcacaactatgggttcattccacgtactatttgtgacgacggtgatcccatggatgtcttggttattatgcaggagccagttcttccgggttgctttcttcgggccaaagctattggtctcatgcctatgattgatcagggtgagacagatgacaagataattgctgtctgtgctgat

SEQ ID NO: 7301 - DNA, 269 bp, Glycine max
  Clone ID: 701008308H1
taggacctgaagctccaaagatcttcaactgtgtggttgaaattgggaaaggaagtaaggtgaaatatgaacttcacaaaagaactggtcttattatggttgatcgtatcctttactcatcggctgtgtatcctcacaactatgggtttatcccacgtactatttgtgaggatggtgatcccatggatgtcttggttatcatgcaggagccagttcttccaggttgctttctacgggccaaagctattggactcatgcctatgattgat

SEQ ID NO: 7302 - DNA, 276 bp, Glycine max
  Clone ID: 700559054H1
cttaacgagaggattctttcatccatttccaggagacacgttgctgcacacccgtggcacgatcttgagataggacccgaagctccaaagatcttcaactgtgtggtcgaaatagggaaaggaagcaaggtgaaatatgaacttgacaaaagaactggacttattatggttgatcgtatactttactcatcagttgtttatcctcacaactatgggtttattccacgtactatttgtgaggacggtgatcccatggatgtcttggtattatgcagg

SEQ ID NO: 7303 - DNA, 239 bp, Glycine max
  Clone ID: 700790983H1
acttattatggttgatcgtatactttactcatcagttgtttatcctcacaactatgggtttattccacgtactatttgtgaggacggtgatcccatggatgtcttggttattatgcaggagccagtcttccgggttgctttcttcgggccaaagctattggtctcatgcctatgattgatcagggtgagaaagatgacaagataattgctgtctgtgctgatgatcctgagtataggca

SEQ ID NO: 7304 - DNA, 268 bp, Glycine max
  Clone ID: 701007949H1
taggacctgaagctccaaagatcttcaactgtgtggttgaaattgggaaaggaagtaaggtgaaatatgaacttgacaaaagaactggtcttattatggttgatcgtatcctttcctcatcggttgtgtatcctcacaactatgggtttatcccacgtactatttgtgaggatggtgatcccatggatgtcttggttatcatgcaggagccagttcttccaggttgctttctacgggccaaagctattggactcatgcctatgattga

SEQ ID NO: 7305 - DNA, 269 bp, Glycine max
  Clone ID: 701123827H1
ctgtttcttctttttctccaaccttcgtttcaccaccacacttacattactttgtcgaaatggctccaccaattgagaccccaaacaaggtttccagctatcaacagtccccaaaccctcgtcttaacgagaggattcttagatacatttccaggagacacgttgctgcacacccgtggcacgatcttgagataggacccgtagctccaaagatcttcaactgtgtggtcgaaatagggaaaggaagcaaggtgaaatatgaacttgac

SEQ ID NO: 7306 - DNA, 269 bp, Glycine max
  Clone ID: 701013616H1
ttctcactctagatctgtgtttctctctccaaccttcgtttcaccacacttccatcacttgtcgagtgtagaaatggctccaccaattgagaccccaaccaaggtttccagctatcagcactccccaaaccctcgtcttaacgagaggattctttcatccatttccaggaaacatgttgctgctcacccgtggcatgatcttgagataggacctgaagctccaaagatcttcaactgtgtggttgaaattgggaaaggcagtaaggtga

SEQ ID NO: 7307 - DNA, 269 bp, Glycine max
  Clone ID: 701013624H1
ttctcactctagatctgtgtttctctctccaaccttcgtttcaccacacttccatcacttgtcgagtgtagaaatggctccaccaattgagaccccaaccaaggtttccagctatctgcactccccaaaccctcgtcttaacgagaggattctttcatccatttccaggaaacatgttgctgctcacccgtggcatgatcttgagataggacctgaagctccaaagatcttcaactgtgtggttgaaattgggaaaggaagtaaggtga

SEQ ID NO: 7308 - DNA, 254 bp, Glycine max
  Clone ID: 700888553H1
ctcacacctcatcgtttctctctctagatctctgtttcttctttttctccaaccttcgtttcaccaccacacttacattactacatcgaaatggctccaccaattgagaccccaaacaaggtttccagctatcaacagtccccaaaccctcgtcttaacgagaggattctttcatccatttccaggagacacgttgctgcacacccgtggcacgatcttgagataggacccgaagctccaaagatcttcaactg

SEQ ID NO: 7309 - DNA, 268 bp, Glycine max
  Clone ID: 701106256H1
cggctcgagcacacctcatcgtttctctctctagatctctgtttcttctttttctccaaccttcgtttcaccaccacacttacattactttgtcgaaatggctccaccaattgagaccccaaacaaggtttccagctatcaacagtccccaaaccctcgtcttaacgataggattctttcatccatttccaggagacacgttgctgcacacccgtggcacgatcttgagataggacccgaagctccaaagatcttcaactgtgtggtc

SEQ ID NO: 7310 - DNA, 250 bp, Glycine max
  Clone ID: 701214976H1
ctcacacctcatcgtttctctctctagatctctgtttcttctttttctccaaccttcgtttcaccaccacacttacattactttgtcgaaatggctccaccaattgagaccccaaacaaggtttccagctatcaacagtccccaaaccctcgtcttaacgagaggattctttcatccatttccaggagacacgttgctgcacacccgtggcacgatcttgagataggagccgaagctccaaagatcttca

SEQ ID NO: 7311 - DNA, 283 bp, Glycine max
  unsure (1)...(283): unsure at all n locations
  Clone ID: 700565624H1
atttcatttcactcactcantcttcgtttcgtttctctttctcactctagatctgtgtttctctctaccaaccttcgtttcaccacacttccatcacttgtcgagtgtagaaatggctccaccaattgagaccccaaccaaggtttccagctatcagcactccccanaccctccgtcttaacgagaggattctttcatccatttccaggaaacatgttgctgctcacccgtggcatgatcttgagataggacctgaagctccaaagatcttcaactgtgtggt

SEQ ID NO: 7312 - DNA, 269 bp, Glycine max
  Clone ID: 701121092H1
attccacacacaccacaacatcacactctctagatctctgtttcttctttttctccaaccttcgtttcaccaacacacttacattactttgtcgaaatggctccaccaattgagaccccaaacaaggtttccagctatcaacagtccccaaaccctcgtcttaacgagaggattctttcatccatttccaggagacacgttgctgcacacccgtggcacgatcttgagataggacccgaagctccaaagatcttcaactgtgtggtcga

SEQ ID NO: 7313 - DNA, 246 bp, Glycine max
  Clone ID: 700788808H2
cacacctcatcgtttctctctctagatctctgtttcttctttttctccaaccttcgtttcaccaccacacttacattactttgtcgaaatggctccaccaattgagaccccaaacaaggtttccagctatcaacagtccccaaaccctcgtcttaacgagaggattctttcatccatttccaggagacacgttgctgcacactcgtggcacgatcttgagataggacccgaagctccaaagatctt

SEQ ID NO: 7314 - DNA, 247 bp, Glycine max
  Clone ID: 701099192H1
tccactcacacctcatcgtttctctctctagatctctgtttcttctttttctccaaccttcgtttcaccaccacacttacattactttgtcgaaatggctccaccaattgagaccccaaacaaggtttccagctatcaacagtccccaaaccctcgtcttaacgagaggattctttcatccatttccaggagacacgttgctgcacacccgtggcacgatcttgagataggacccgaagctccaaag

SEQ ID NO: 7315 - DNA, 251 bp, Glycine max
  Clone ID: 700889521H1
cattccactcacacctcatcgtttctctctctagatctctgtttcttctttttctccaaccttcgtttcaccaccacacttacattactttgtcgaaatggctccaccaattgagaccccaaacaaggtttccagctatcaacagtccccaaaccctcgtcttaacgagaggattctttcatccatttccaggagacacgttgctgcacacccgtggcacgatcttgagataggacccgaagctccaaaga

SEQ ID NO: 7316 - DNA, 265 bp, Glycine max
  unsure (1)...(265): unsure at all n locations
  Clone ID: 700971218H1
gcattccactcacacctcatcgtttctctctctagatctctntttcttctttttctccaaccttcgtttcaccaccacacttacattactttgtcgaaatggctccaccaattgagaccccaaacaaggtttccagctatcaacagtccccaaaccctcgtcttaacgagaggattctttcatccatttccaggagacacgttgctgcacaccgtgggcacgatcttgagataggacccgaagctccaaagacttnaatgtgtgg

SEQ ID NO: 7317 - DNA, 256 bp, Glycine max
  Clone ID: 701099236H1
cgtttctctctctagatctctgtttcttctttttctccaaccttcgtttcaccaccacacttacattacttcgtcgaaatggctccaccaattgagaccccaaacaaggtttccagctatcaacagtccccaaaccctcgtcttaacgagaggattctttcatccatttccaggagacacgttgctgcacacccgtggcacgatcttgagataggacccgaagctccaaaagattccaactgtgtggccgaaatag

SEQ ID NO: 7318 - DNA, 343 bp, Glycine max
  unsure (1)...(343): unsure at all n locations
  Clone ID: 700648547H1
agcantccactcacacctcatctcttgctctctctagatctctgtttcttcttnttctccaaccttcgtttcaccancacacttnncattacttgtcgaaatggctccaccattgagaccccaaacaaggtttcagctatcaacagtcccaaacctcgtcttaacgagaggntcttccatccatttccaggagcacgttgtgcacaccngtggcagnctgaagataggaccgaagctccaaagatcttcaactgtgtggcgaaatagggaaaggaannnggtgaatatgaacttgacaaangaactggacttattatggtgacgtatacttacccacagtgtt

SEQ ID NO: 7319 - DNA, 241 bp, Glycine max
  Clone ID: 700834052H1
atttcatttcactcactcactcttcgtttcgtttctctttctcactctagatctgtgtttctctctccaaccttcgtttcaccacacttccatcacttgtcgagtgtagaaatggctccaccaattgagaccccaaccaaggtttccagctatcagcactccccaaaccctcgtcttaacgagaggattctttcatccatttccaggaaacatgttgctgctcacccgtggcatgatcttg

SEQ ID NO: 7320 - DNA, 269 bp, Glycine max
  Clone ID: 700906027H1
tgtgtcacatcgcttatttctggattccttggaatgaaaattgcaacttatgccaatgcaagaaccaccctggaggcaagaaagggtgttggaaaggctttcattacggcttttagatctggtgcagttatgggttttctccttgctgcaaatggtcttttggttctttacattgccatcaacttgttcaagatttactatggtgatgactggggtggtctttttgaggccatcactggttatggtcttggtgggtcttctatggcttt

SEQ ID NO: 7321 - DNA, 246 bp, Glycine max
  Clone ID: 700751263H1
tgaaaattgcaacttacgccaatgcaagaaccaccctggaggcaagaaagggtgttgggaaggctttcattacggcttttagatctggtgcagttatgggttttctccttgctgcaaatggtcttttggttctttacattgccatcaacttgttcaagatttactatggtgatgactggggtggtctttttgaggccatcactggttatggtcttggtgggtcttctatggctttgtttggaagag

SEQ ID NO: 7322 - DNA, 283 bp, Glycine max
  Clone ID: 701208611H1
tatatgaccaaactaaaatgtgtaagccagctcttgccactgctgatttcagcaccatatctttcctgcttggaggtgtcacatcgcttatttctggattccttggaatgaaaattgcaacttatgccaatgcaagaaccaccctggaggcaagaaagggtgttggaaaggctttcattacggcttttagatctggtgcagttatgggttttctccttgctgcaaatggtcttttggttctttacattgccatcaacttgttcaagatttactatggtgatga

SEQ ID NO: 7323 - DNA, 244 bp, Glycine max
  Clone ID: 700832676H1
tcttgctactgctgttttcagcaccatatctttcctgcttggtggtgtcacatcgcttatttctggattccttggaatgaaaattgcaacttacgccaatgcaagaaccaccctggaggcaagaaagggtgttgggaaggctttcattacggcttttagatctggtgcagttatgggttttctccttgctgcaaatggtcttttggttctttacattgccatcaacttgttcaagatttactat

SEQ ID NO: 7324 - DNA, 247 bp, Glycine max
  unsure (1)...(247): unsure at all n locations
  Clone ID: 700979128H1
tgcaacttacgccaatgcaagnnccaccctggaggcaaganagggtgttgggnaggcttcattacggcttttagatctggtgcagttatgggttttctccttgctgcaaatggtcttttggttctttacattgccatcacttgttcaagatttactatggtgatgactggggtggtcttttgaggccatcactggttatggtcttggtgggtcttctatggcntgtttggaagagttggtggaggta

SEQ ID NO: 7325 - DNA, 231 bp, Glycine max
  Clone ID: 700751040H1
gggaaggctttcattacggcttttagatctggtgcagttatgggttttctccttgctgcaaatggtcttttggttctttacattgccatcaacttgttcaagatttactatggtgatgactggggtggtctttttgaggccatcactggttatggtcttggtgggccttctatggctttgttcggaagagttggtggaggtatctatactaaggctgctgatgttggtgct

SEQ ID NO: 7326 - DNA, 164 bp, Glycine max
  Clone ID: 700957555H1
cggctcgaggcttggtggtgtcacatcgcttatttgtggattccttggaatgaaaattgcaacttacgccaatgggagaaccaccctggaggcaagaaagggtgttgggaaggctttcattacggcttttagatctggtgcagttatgggttttctccttgctg

SEQ ID NO: 7327 - DNA, 349 bp, Glycine max
  Clone ID: LIB3028-012-Q1-B1-B8
gttctgtgggtatccttgtttgtttgctcacaaccttatttgcaactgacttctttgagatcaaggctgtaaaggagattgagcctgcattgaagaaacaactcatcatttccactgccctgatgactattgggattgcaattgttagttggattgcactcccaacttccttcactatcttcaattttggagttcagaaagatgtcaagaattggcagctattcttgtgtgttgctgttggtctttgggcaggtcttattattggatttgtaactgagtactatactagcaatgcatatagtccggtgcaagatgttgcagactcctgcaggactggtgctgcaactaa

SEQ ID NO: 7328 - DNA, 378 bp, Glycine max
  Clone ID: LIB3028-012-Q1-B1-A6
gttctgtgggtatccttgtttgtttgctcacaaccttatttgcaactgacttctttgagatcaaggctgtaaaggagattgagcctgcattgaagaaacaactcatcatttccactgccctgatgactattgggattgcaattgttagttggattgcactcccaacttccttcactatcttcaattttggagttcagaaagatgtcaagaattggcagctattcttgtgtgttgctgttggtctttgggcaggtcttattattggatttgtaactgagtactatactagcaatgcatatagtccggtgcaagatgttgcagactcctgcaggactggtgctgcaactaatgttatatttggccttgccttgggataca

SEQ ID NO: 7329 - DNA, 444 bp, Glycine max
  unsure (1)...(444): unsure at all n locations
  Clone ID: LIB3040-003-Q1-E1-F6
tacggctgcgagaagacgacagaaggggacacacgttctctgtgactgcctctgttccgccaagcgcagcattttcccaccgttcaggccaccggctgagttaggtttccggcgaggatgggtgctgctctgctgtcggagcttgcgacggagatagtcgtgccagtgtgcgccgtcatcgggatcgtgttctcgctggtgcagtggttcctcgtgtcgcgcgtcaagctcactcccgaccgcaacggaacgacgtcgtcgccgcgcaacaacaaaaacggctacggcgacttcctcattgaagaggaagaaggcatcaacgaccacagcgtcgttgtgaaatgcgctgagatacagaacgctatctccgaaggtgcaacatcctttcttttcactgaatatcaatatgtgnggattttcatggttgcttttgcaatactgatc

SEQ ID NO: 7330 - DNA, 436 bp, Glycine max
  unsure (1)...(436): unsure at all n locations
  Clone ID: LIB3051-114-Q1-K1-G5
ctgcctctgttccgccaagcgcagcattttcccaccgttcaggccaccggctgagttaggtttccggcgaggatgggtgctgctctgctgtcggagcttgcgacggagatagtcgtgccagtgtgcgccgtcatcgggatcgtgttctcgctggtgcagtggttcctcgtgtcgcgcgtcaagctcactcccgaccgcaacggaacgacgtcgtcgccgcgcaacaacaaaaacggctacggcgacttcctcattgaagaagaagaaagcatcaacgaccacagcgtcgttgtgaaatgcgctgagatacagaacgctatctccgaaggtgcaacatcctttcttttcactgaatatcaatatgtggggatcttcatggttgcttttgcaatactgatcttnctttttctgtgctctgtggaaggcttcagtacta

SEQ ID NO: 7331 - DNA, 408 bp, Glycine max
  Clone ID: LIB3039-020-Q1-E1-A2
acggctgcgagaagacgacagaagggggagcttccctcacacattctctgtgactgcctctgttccgccgaacccagcattttcccaccgttcgggccaccggcggagttagttttccggcaaggatgggtgctgctctgctgtctgagcttgcgacggagatagttgtgccggcctgcgccgtcatcgggatcgtgttctcgttggtgcagtggttcctcgtgtcgcgcgtcaagctcactcccgaccgaaacggaacgacgtcgtcgccgcgcaacaacaagaacggctacggcgacttcctcattgaggaggaagaaggcatcaacgaccacagcgtcgttgtgaaatgcgctgagatacagaacgctatctccgaaagtgcaacatcctttcttttcactgaat

SEQ ID NO: 7332 - DNA, 394 bp, Glycine max
  Clone ID: LIB3065-010-Q1-N1-H3
cgtccatcatttttctacaacgacagaacaaggaaaagccgtgcctttaccaatgccttctcgtttttgtgttagtctttaactcatctgtcatgtcaattccattgtttttgaaaccttttcctcccccaccttgaaacaaagtatattttgtctcatgtagttttaagacaacttgattaggctgagtctgttgcgaaaattttccttgtatgatgacgatgatgtttaccatctcttccgcgtggtcaattttctaaatatattcctttccggatggttcaactttcttaatatttctttaccattttgtttttattggattgtctggttttaaaaatgtttgcaattggactaattcaattataactaaaaattaataattcaaggaatt

SEQ ID NO: 7333 - DNA, 410 bp, Glycine max
  Clone ID: LIB3051-070-Q1-K1-B12
gctgcaaccaatgtcatctttggccttgctctgggatacaagtctgtcattattcctatttgggccatcgcaatcagcatttttgtgagttttacttttgctgcaatgtatggcattgctgtggctgcccttgggatgctgagcaccattgcgacagggttggctattgatgcctatgggccaatcagtgacaatgcaggaggtattgctgagatggcaggcatgagccatcgtattcgtgagagaactgatgcccttgatgctgctggcaacactactgctgccataggcaaaggatttgctaatgggtctgctgcttttgtgtctttggccctaattggtgcatttgggaaccgaacttgaattttgacttgtgatgtcttgacttccaaagtctttattggactcat

SEQ ID NO: 7334 - DNA, 431 bp, Glycine max
  Clone ID: LIB3051-010-Q1-E1-G8
actgatttgcctcttcttctagttggatatggatttggtgcctcctttgttgcactatttgcccagttgggtggtggaatatacacaaaggccgctgatgttggagcagaccttgtcggaaaagtagaacagggaatacctgaagacgaccctaggaatcctgctgttattgctgatctggttggtgacaatgtgggagattgtgctgctcgaggtgctgatctttttgaaagtattgcagctgaaataattagtgccatgatacttggtggaacaatggcacaacgctgtaaaattgcagatccatctggcttcatcttgtttcctcttgttgttcactcattcgatctgatagtttcatcagctggaatattttctatcaagggtacacgtgaaactggagttatagttcctgtggaggattcaatgac

SEQ ID NO: 7335 - DNA, 396 bp, Glycine max
  Clone ID: LIB3028-026-Q1-B1-B7
gactctttctcttatctctaagtcaacatggctcaccttgaagattcaagtgcatggaattcgagtatacctcaccctaagctcaatgaaagaattctgtcttctctgtcacggagaactgttgctgctcacccctggcacgatttagagattgggccaggagctccagctgttttcaactgtgtggttgaaattggcaaaggcagtaaggttaagtatgagctggacaagacaagtggacttataaaggttgatcgtattctttactcatcagttgtctacccacacaactatggttttatcccaagaaccatttgtgaagacagtgatcctatggacgtgctggttctaatgcaggaacccgtgcttcctggttccttccctcgtgctcgtgct

SEQ ID NO: 7336 - DNA, 439 bp, Glycine max
  Clone ID: LIB3039-007-Q1-E1-H3
gcgtccaacggatgcgagaagcgacagaaggggaagatggttgaagaagtacgcaggcaattcaacaccattccagggttgatggagggaactgctaagcctgactatgccacatgtgttaagatctccactgatgcttccattaaagaaatgattccacctggtgctcttgtcatgcttacaccgcttgttgttggaatcctttttggtgttgaaacactttctggtgtcctagctggatctttggtgtctggtgtacagattgctatttctgcatccaacaccggtggtgcttgggataatgccaagaagtacattgaggctggtgcttctgagcatgcaagaagccttggtccaaaagggtcagattgtcacaatgcagctgttattggtgacaccattggagaccctctaaaggatacatctggaccttcactta

SEQ ID NO: 7337 - DNA, 402 bp, Glycine max
  Clone ID: LIB3050-012-Q1-E1-B11
tacggctgcgagaagacaacagaaggggtccaatcagtgacaatgctggaggtattgctgaaatggctggtatgagtcacagaattagagagagaactgatgcccttgatgctgccggaaacacgactgccgctattgggaagggatttgccattggttctgctgcccttgtatcactggccctctttggtgcctttgtgggccgagctgctattacaactgttgatgtgttgactccaaaggttttcattggtttgattgtgggtgcaatgcttccttactggttttctgctatgactatgaagagtgtgggaagtgctgctctgaagatggttgaagaagtacgcaggcaattcaacaccattccaaggttgatggagggaactgctaagcctgactatg

SEQ ID NO: 7338 - DNA, 352 bp, Glycine max
  Clone ID: LIB3049-005-Q1-E1-A7
agtacggctgcgagaagacgacagaaggggacagaacaatagtagcaagcagagccccaagatctgtgcttgaaccttcacgtgtgtttccttccttctgcagacgagcttcaccttgcgccgaagggccacagatggttgaaaccgatatggatgccgaaactgttgcaaatgtggttccaccaaaggagactccaaacagtgttcccatctcttatcattcctcacactcacaccctcctcttaatgagaggattatttcatccatgaccagaagatctgttgctgcacacccgtggcacgaccttgagataaggcctgatgctccaacgatcttcaattgtgtgattga

SEQ ID NO: 7339 - DNA, 251 bp, Glycine max
  Clone ID: LIB3050-013-Q1-E1-G8
agtacggctgcgagaagacgacagaaggggcacacccgtggcacgatcttgagataagacccgaagctccaaagatcttcaactgtgtggtcgaaataaggaaaggaagcaaggtgaaatatgaacttgacaaaagaactggacttattatggttgatcgtatactttactcatcagttgtttatcctcacaactatgggtttattccacgtactatttgtgaggacggtgattccatggatgtcctgggt

SEQ ID NO: 7340 - DNA, 401 bp, Glycine max
  Clone ID: LIB3073-025-Q1-K1-D6
gagactcaacaagcattccactcacacctcatcgtttctctctctagatctctgtttcttctttttctccaaccttcgtttcaccaccacacttacattactttgtcgaaatggctccaccaattgagaccccaaacaaggtttccagctatcaacagtccccaaaccctcgtcttaacgagaggattctttcatccatttccaggagacacgttgctgcacacccgtggcacgatcttgagataggacccgaagctccaaagatcttcaactgtgtggtcgaaatagggaaaggaagcaaggtgaaatatgaacttgtcaaaagaactggacttattatggttgatcgtatactttactcatcagttgtttatcctcacaactatgggtttattccacgt

SEQ ID NO: 7341 - DNA, 411 bp, Glycine max
  unsure (1)...(411): unsure at all n locations
  Clone ID: LIB3050-012-Q1-E1-D1
agtacggctgcgagagacgacagaaggggagactcaacaagcattccactcacacctcatcgtttctctctctagatctctgtttcttctttttctccaaccttcgttttaccaccacacttacattactttgtcgaaatggctccaccaattgagaccccaaacaaggtttccagctatcaacagtccccaaaccctcgtcttaacgagaggattctttcatccatttccgggagacacgttgctgcacacccgtggcacgatcttgagatanngaccgaagctccaaagatcttcaactgtgtggtcganatanggaaaggaagcaaggtgaaatatgaacttgacaaaagaactggacttattatggttgatcgtatactttactcatcagttgtttatcctcacaac
